United States Patent
Spurbeck et al.

(10) Patent No.: US 11,702,653 B2
(45) Date of Patent: Jul. 18, 2023

(54) CONTROL COMPOSITIONS AND METHODS FOR SEQUENCING

(71) Applicant: BATTELLE MEMORIAL INSTITUTE, Columbus, OH (US)

(72) Inventors: Rachel R. Spurbeck, Columbus, OH (US); Richard Mon Che Chou, Columbus, OH (US); Anthony D. Duong, Columbus, OH (US)

(73) Assignee: BATTELLE MEMORIAL INSTITUTE, Columbus, OH (US)

( * ) Notice: Subject to any disclaimer, the term of this patent is extended or adjusted under 35 U.S.C. 154(b) by 0 days.

(21) Appl. No.: 16/418,521

(22) Filed: May 21, 2019

(65) Prior Publication Data

US 2019/0382757 A1    Dec. 19, 2019

Related U.S. Application Data

(60) Provisional application No. 62/801,520, filed on Feb. 5, 2019, provisional application No. 62/703,266, filed on Jul. 25, 2018, provisional application No. 62/674,533, filed on May 21, 2018.

(51) Int. Cl.
| | | |
|---|---|---|
| C12N 15/10 | (2006.01) | |
| C12N 15/113 | (2010.01) | |
| C12Q 1/6869 | (2018.01) | |
| C12Q 1/6876 | (2018.01) | |

(52) U.S. Cl.
CPC ........ *C12N 15/1089* (2013.01); *C12N 15/113* (2013.01); *C12Q 1/6869* (2013.01); *C12Q 1/6876* (2013.01); *C12Q 2563/185* (2013.01); *C12Q 2600/166* (2013.01)

(58) Field of Classification Search
None
See application file for complete search history.

(56) References Cited

U.S. PATENT DOCUMENTS

| | | |
|---|---|---|
| 2006/0058249 A1 | 3/2006 | Tong et al. |
| 2006/0073506 A1 | 4/2006 | Frederick |
| 2007/0072212 A1 | 3/2007 | Vinayagamoorthy |
| 2008/0254453 A1 | 10/2008 | Shapero |
| 2010/0240064 A1 | 9/2010 | Jeddeloh |
| 2011/0076726 A1 | 3/2011 | Lakey |
| 2012/0208193 A1 | 8/2012 | Okino |
| 2015/0322508 A1 | 11/2015 | Miguel |
| 2016/0257984 A1 | 9/2016 | Hardenbol et al. |
| 2016/0257993 A1 | 9/2016 | Fu et al. |
| 2016/0281182 A1 | 9/2016 | Monpoeho et al. |
| 2017/0275691 A1 | 9/2017 | Christians et al. |
| 2017/0292149 A1 | 10/2017 | Sherwood |
| 2019/0300948 A1 | 10/2019 | Cuppens |
| 2020/0277672 A1 | 9/2020 | Freeman |

FOREIGN PATENT DOCUMENTS

| | | |
|---|---|---|
| EP | 3246412 | 11/2017 |
| WO | 2004083819 | 9/2004 |
| WO | 2009/036525 | 3/2009 |
| WO | WO2011/156795 | 12/2011 |
| WO | 2016179530 | 11/2016 |
| WO | 2017058936 | 4/2017 |
| WO | 2017/165864 | 9/2017 |
| WO | 2017192974 | 11/2017 |
| WO | 2018119301 | 6/2018 |
| WO | 2019/226648 | 11/2019 |

OTHER PUBLICATIONS

Kaifu Chen et al. The Overlooked Fact: Fundamental Need for Spike-In Control for Virtually All Genome-Wide Analyses Molecular and Cellular Biology Mar. 2016 vol. 36 No. 5.*
Qu et al. Development of ERCC RNA Spike-In Control Mixes J Biomol Tech. Oct. 2011; 22(Suppl): S46.*
Wong et al. ANAQUIN: a software toolkit for the analysis of spike-in controls for next generation sequencing Bioinformatics, 33(11), 2017, 1723-1724 doi: 10.1093/bioinformatics/btx038 Advance Access Publication Date: Jan. 27, 2017.*
Quail et al. SASI-Seq: sample assurance Spike-Ins, and highly differentiating 384 barcoding for Illumina sequencing BMC Genomics vol. 15, Article No. 110 (2014) Published: Feb. 7, 2014.*
Chen et al. Effects of GC Bias in Next-Generation-Sequencing Data on De Novo Genome Assembly PLoS ONE 8(4): e62856. doi:10. 1371/journal.pone.0062856.*
Kojima et al Nucleic Acids Research, 2005, vol. 33, No. 17 e150 doi: 10.1093/nar/gni143.*
Dauphin et al Journal of Applied Microbiology 108 (2010) 163-172.*
Hammer et al. FEBS Letters 586 (2012) 2882-2890.*
Zelikin et al. vol. ACSNANO 1 ■ No. 1 ■ 63-69 ■ 2007.*
O'Connell et al. (High Interspecimen Variability in Nucleic Acid Extraction Efficiency Necessitates the Use of Spike-In Control for Accurate qPCR-based Measurement of Plasma Cell-Free DNA Levels, Laboratory Medicine 48:4:332-338, DOI: 10.1093/labmed/lmx043.*
Stoeckel et al. Water Research 42 4820-4827, Jun. 4, 2009.*
Zhang et al. (Results of first proficiency test for KRAS testing with formalin-fixed, paraffin-embedded cell lines in China, Clin Chem Lab Med 2014; 52(12): 1851-1857.*

(Continued)

*Primary Examiner* — Joseph Woitach
(74) *Attorney, Agent, or Firm* — Barnes & Thornburg LLP

(57) ABSTRACT

The invention relates to control compositions for sequencing and for chemical analyses, such as analytical chemistry analyses. More particularly, the invention relates to control compositions for sequencing and for chemical analyses having at least one barcode sequence fragment and at least one universal sequence fragment, and to methods of their use.

16 Claims, 14 Drawing Sheets

Specification includes a Sequence Listing.

(56) References Cited

OTHER PUBLICATIONS

Sundquist et al Identifying and Preventing DNA Contamination in a DNA-Typing Laboratory Promega.com, Sep. 2005.*
Kozarewa et al. Nature Methods 2009; 6:291-295.
Jiang, L. et al., "Synthetic spike-in standards for RNA-seq experiments," Genome Research, 2011, 21(9) 1543-51.

* cited by examiner

| Soil Sample | Count R1 | Count R2 | Raw Read Count | Ccc1 Identification |
|---|---|---|---|---|
| CCC1-ENCAPSULATED | 173,762 | 2 | 250,385 | 69% |
| CCC1-NONENCAPSULATED | 214,749 | 1 | 290,048 | 74% |
| CCC2-ENCAPSULATED | 385 | 0 | 202,662 | 0% |
| CCC2-NONENCAPSULATED | 375 | 0 | 182,636 | 0% |
| CCC1-CCC2-ENCAPSULATED | 83,406 | 1 | 175,396 | 48% |

| Soil Sample | Count R1 | Count R2 | Raw Read Count | CCC2 Identification |
|---|---|---|---|---|
| CCC1-ENCAPSULATED | 1,437 | 0 | 250,385 | 1% |
| CCC1-NONENCAPSULATED | 631 | 0 | 290,048 | 0% |
| CCC2-ENCAPSULATED | 121,097 | 1 | 202,662 | 60% |
| CCC2-NONENCAPSULATED | 122,405 | 1 | 182,636 | 67% |
| CCC1-CCC2-ENCAPSULATED | 53,703 | 1 | 175,396 | 31% |

*FIG. 4*

Low Quantity Standard

High Quantity Standard

CONTROL COMPOSITIONS AND METHODS FOR SEQUENCING

CROSS-REFERENCE TO RELATED APPLICATIONS

This application claims priority under 35 U.S.C. § 119(e) to U.S. Provisional Application Ser. No. 62/674,533 filed on May 21, 2018, U.S. Provisional Application Ser. No. 62/703,266 filed on Jul. 25, 2018 and U.S. Provisional Application Ser. No. 62/801,520 filed on Feb. 5, 2019, the entire disclosures of which are incorporated herein by reference.

SEQUENCE LISTING

The instant application contains a Sequence Listing which has been submitted electronically in ASCII format and is hereby incorporated by reference in its entirety. Said ASCII copy, created on Jul. 10, 2019, is named 920006-295629_SL.txt and is 777,782 bytes in size.

FIELD OF THE DISCLOSURE

The invention relates to control compositions for sequencing and chemical analyses. More particularly, the invention relates to control compositions for sequencing and chemical analyses having at least one barcode sequence fragment and at least one universal sequence fragment, and to methods of their use.

BACKGROUND AND SUMMARY OF THE INVENTION

Sequencing controls are needed that can be used starting after the extraction step (e.g., by spiking the extract with the control constructs) or in every step of analysis of an unknown test sample (e.g., from nucleic acid extraction to nucleic acid purification to library preparation and sequencing). Sample swapping or sample-to-sample contamination can occur during any of these steps, but without a priori knowledge of what is in the sample, one may not know if the samples were contaminated or just contained similar genetic profiles. Also, sequencing controls that can be used both for 1) detection of sample swapping and sample-to-sample contamination, and 2) quantitation are needed.

For quantitation, metagenomic communities are currently analyzed by determining the relative abundance of 16S genes or unique k-mers that can differentiate microbial species and strains. However, the methods used to process the samples can influence the relative abundance of the community members. For example, during DNA extraction, the chemical or physical lysis process can bias the analysis due to different lysis efficiencies for different microbial membranes and cell wall compositions (e.g., fungi typically are underrepresented in metagenomes due to lysis resistance). After DNA extraction, the library preparation method can also add additional bias. As an example, amplification of library molecules relies on polymerases which can bias results towards fifty percent GC content fragments or shorter fragments versus longer molecules, as polymerases tend to amplify shorter fragments and lower GC content or balanced molecules faster than molecules with high GC content.

Analytical chemistry analysis of unknown materials can be confounded by identification of compounds that do not seem to fit with what is expected. These unexpected compounds could be the result of a cross contamination event or may actually be present in the sample. Therefore, spike-in cross contamination and sample swapping controls are also needed for analytical chemistry analyses.

The present invention provides sequencing controls that can be used starting after the extraction step (e.g., by spiking the extract with the control constructs) or in every step of analysis of an unknown test sample (e.g., from nucleic acid extraction to nucleic acid purification to library preparation and sequencing). In one embodiment, nucleic acid constructs comprising a barcode sequence fragment are provided that can be encapsulated in a simulated cell membrane (e.g., a simulated bacterial cell membrane or eukaryotic cell membrane), or embedded directly in the genome of an organism for use as spike-in sequencing controls. In one aspect, the barcode sequence fragment comprises a unique sequence not present in any known genome. In one embodiment, the sequencing controls can be spiked into the unknown test sample prior to or after nucleic acid extraction and then can be detected in the final sequenced samples. In another embodiment, different nucleic acid constructs (i.e., with different barcode sequence fragments) can be spiked into different samples so that cross-contamination of samples or sample swapping can be detected.

In one embodiment, the barcode sequence fragment can be flanked by universal sequence fragments. The universal sequence fragments can add length to the nucleic acid construct and can serve as markers for bioinformatic analysis to identify the beginning and end of the barcode sequence fragment after sequencing. In another illustrative aspect, the barcode sequence fragment may be flanked by primer binding site sequence fragments (i.e., directly or indirectly linked to the barcode sequence fragment) so that the nucleic acid construct comprising the barcode sequence fragment can be amplified during an amplicon sequencing protocol. In another embodiment, primer binding site sequence fragments may be lacking for use of the sequencing controls in whole genome sequencing protocols. In another embodiment, a set of different nucleic acid construct spike-ins with different barcode sequence fragments (e.g., 384 or 96 different barcode sequence fragments) can be used to allow for multiplexing of samples on one sequencing run.

In various embodiments, samples with microorganisms containing nucleic acids (e.g., DNA), or samples with other sources of nucleic acids, may be analyzed by sequencing using the control compositions for sequencing described herein. The samples can be, for example, selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, and an animal sample.

In another embodiment, a method is provided for the use of spike-in controls that simultaneously 1) control for cross-contamination and/or sample swapping and 2) allow for quantitation while controlling for different GC content samples (e.g., low, balanced, and high GC content) and/or for different lysis efficiencies. In one aspect, barcoded DNA molecules are produced with different GC contents, using GC content fragments, wherein the barcode sequence fragments and the GC content fragments are flanked by universal sequence fragments, and then the nucleic acid construct is encapsulated in a simulated cell membrane. By using the same type of nucleic acid construct, but with different barcode sequence fragments, different quantities of the encapsulated nucleic acid construct can be spiked-in, and a standard curve for quantitation can be produced. In this embodiment, the barcode sequence fragments can be used to verify that no cross-contamination or sample swapping occurred during sample preparation or processing. Also in this quantitation embodiment, the different GC content fragments (e.g., low, balanced, and high GC content) have the same barcode sequence fragment at each GC percentage (e.g., low, balanced, and high GC content), but at each separate concentration of the nucleic acid construct used to produce the standard curve, the barcode sequence fragments are unique to each concentration used to produce the standard curve. In this embodiment, the encapsulation method can also be varied to control for different resistances to lysis to mimic, for example, Gram positive, Gram negative, and fungal cell walls. In this encapsulation embodiment, the type of encapsulation method can be correlated to a unique barcode sequence fragment in the nucleic acid construct to enable differentiation post sequencing.

The present invention also provides spike-in cross-contamination and sample swapping controls for analytical chemistry analysis of unknown materials. These controls can be used in analytical chemistry procedures, such as mass spectrometry.

The following clauses, and combinations thereof, provide various additional illustrative aspects of the invention described herein. The various embodiments described in any other section of this patent application, including the section titled "DETAILED DESCRIPTION OF ILLUSTRATIVE EMBODIMENTS" and the "EXAMPLES" are applicable to any of the following embodiments of the invention described in the numbered clauses below.

1. A sequencing control composition, said control composition comprising a nucleic acid construct comprising at least one barcode sequence fragment linked at its 5' or 3' end to at least one universal sequence fragment.
2. The control composition of clause 1 wherein the control composition is used to determine if cross-contamination between samples for sequencing has occurred.
3. The control composition of clause 1 wherein the control composition is used to determine if sample swapping has occurred.
4. The control composition of any one of clauses 1 to 3 wherein the nucleic acid construct is a deoxyribonucleic acid construct.
5. The control composition of any one of clauses 1 to 4 wherein the nucleic acid construct comprises at least a first and a second universal sequence fragment.
6. The control composition of clause 5 wherein the first universal sequence fragment is linked to the 5' end of the barcode sequence fragment and the second universal sequence fragment is linked to the 3' end of the barcode sequence fragment.
7. The control composition of any one of clauses 1 to 6 wherein the nucleic acid construct further comprises at least a first and a second primer binding site fragment.
8. The control composition of clause 6 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
9. The control composition of clause 8 wherein the primer binding site fragments range in length from about 15 base pairs to about 30 base pairs.
10. The control composition of clause 8 wherein the nucleic acid construct ranges in length from about 80 base pairs to about 300 base pairs.
11. The control composition of any one of clauses 1 to 6 wherein the sequencing is whole genome sequencing.
12. The control composition of any one of clauses 7 to 10 wherein the sequencing is amplicon sequencing.
13. The control composition of any one of clauses 1 to 12 wherein the sequencing is Next Generation Sequencing.
14. The control composition of any one of clauses 1 to 13 wherein the nucleic acid construct is encapsulated.
15. The control composition of clause 14 wherein the nucleic acid construct is encapsulated in a liposome.
16. The control composition of clause 15 wherein the liposome comprises a lipid selected from the group consisting of cholesterol, a lipopolysaccharide, a peptidoglycan, a PEG, a teichoic acid, a phospholipid, and combinations thereof.
17. The control composition of any one of clauses 1 to 13 wherein the nucleic acid construct is incorporated into the genome of a microorganism.
18. The control composition of any one of clauses 1 to 17 wherein the barcode sequence fragment comprises a unique sequence not present in any known genome.
19. The control composition of any one of clauses 12 to 16 wherein the nucleic acid construct is incorporated into a plasmid.
20. A kit comprising the control composition of any one of clauses 1 to 19.
21. The kit of clause 20 further comprising a reagent for nucleic acid extraction.
22. The kit of clause 20 or 21 further comprising a reagent for nucleic acid purification.
23. The kit of any one of clauses 20 to 22 further comprising a reagent for library preparation.
24. The kit of any one of clauses 20 to 23 further comprising a probe.
25. The kit of any one of clauses 20 to 24 further comprising a reagent for sequencing.
26. The kit of any one of clauses 20 to 25 wherein the kit comprises more than one control composition of any one of clauses 1 to 19 wherein each control composition comprises a different nucleic acid construct wherein the different nucleic acid constructs comprise different barcode sequence fragments.
27. A method for monitoring cross-contamination or sample swapping over all steps of a DNA sequencing protocol including collection of a sample comprising DNA, DNA extraction from the sample, purification of the extracted DNA, library preparation, and sequencing, the method comprising,
   a) spiking the sample with a control composition comprising a nucleic acid construct wherein the nucleic acid construct comprises at least one barcode sequence fragment linked to at least one universal sequence fragment and wherein the nucleic acid construct is a deoxyribonucleic acid construct;
   b) extracting total DNA wherein total DNA comprises the DNA from the sample and DNA from the nucleic acid construct;

c) purifying total DNA;
d) preparing a library from total DNA;
e) sequencing the extracted, purified total DNA; and
f) detecting the nucleic acid construct in total DNA.

28. The method of clause 27 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.

29. The method of clause 27 or 28 wherein the method is used to determine if cross-contamination between samples has occurred.

30. The method of clause 27 or 28 wherein the method is used to determine if sample swapping has occurred.

31. The method of any one of clauses 27 to 30 wherein the step of preparing the library from total DNA comprises a step of amplifying the nucleic acid construct.

32. The method of any one of clauses 27 to 31 wherein the nucleic acid construct comprises at least a first and a second universal sequence fragment.

33. The method of clause 32 wherein the first universal sequence fragment is linked to the 5' end of the barcode sequence fragment and the second universal sequence fragment is linked to the 3' end of the barcode sequence fragment.

34. The method of any one of clauses 27 to 33 wherein the nucleic acid construct further comprises at least a first and a second primer binding site fragment.

35. The method of clause 34 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.

36. The method of clause 35 wherein the primer binding site fragments range in length from about 15 base pairs to about 30 base pairs.

37. The method of clause 35 wherein the nucleic acid construct ranges in length from about 80 base pairs to about 300 base pairs.

38. The method of any one of clauses 27 to 33 wherein the sequencing is whole genome sequencing.

39. The method of any one of clauses 34 to 37 wherein the sequencing is amplicon sequencing.

40. The method of any one of clauses 27 to 39 wherein the sequencing is Next Generation Sequencing.

41. The method of any one of clauses 27 to 40 wherein the nucleic acid construct is encapsulated.

42. The method of clause 41 wherein the nucleic acid construct is encapsulated in a liposome.

43. The method of clause 42 wherein the liposome comprises a lipid selected from the group consisting of cholesterol, a lipopolysaccharide, a peptidoglycan, a PEG, a teichoic acid, a phospholipid, and combinations thereof.

44. The method of any one of clauses 27 to 40 wherein the nucleic acid construct is incorporated into the genome of a microorganism.

45. The method of any one of clauses 27 to 44 wherein the barcode sequence fragment comprises a unique sequence not present in any known genome.

46. The method of any one of clauses 39 to 43 wherein the nucleic acid construct is incorporated into a plasmid.

47. The method of any one of clauses 26 to 33 or 41 to 45 wherein the library preparation step further comprises the step of hybridizing the nucleic acid construct to an immobilized probe before sequencing the nucleic acid construct.

48. The method of clause 47 wherein the probe comprises sequences complementary to the universal sequence fragments in the nucleic acid construct and wherein the probe does not hybridize to the barcode sequence fragment in the nucleic acid construct.

49. The method of any one of clauses 27 to 48 wherein detecting the nucleic acid construct in total DNA comprises
   i) identifying the universal sequence fragment in a sequencing read generated by sequencing the extracted, purified total DNA;
   ii) comparing a sequence fragment adjacent the universal sequence fragment in the sequencing read to the barcode sequence fragment; and
   iii) determining that cross-contamination or sample swapping has occurred in response to the sequence fragment adjacent the universal sequence fragment not matching the barcode sequence fragment.

50. The method of any one of clauses 32 to 48 wherein detecting the nucleic acid construct in total DNA comprises
   i) identifying the first and second universal sequence fragments in a sequencing read generated by sequencing the extracted, purified total DNA;
   ii) comparing a sequence fragment located between the first and second universal sequence fragments in the sequencing read to the barcode sequence fragment; and
   iii) determining that cross-contamination or sample swapping has occurred in response to the sequence fragment located between the first and second universal sequence fragments not matching the barcode sequence fragment.

51. The method of clause 49 or 50, wherein the identifying and comparing steps are performed using a text-matching algorithm.

52. The method of any one of clauses 49 to 51 wherein the identifying step comprises referencing a database of universal sequence fragments that may be included in the nucleic acid construct of the control composition.

53. The method of any one of clauses 49 to 52 wherein the comparing step comprises referencing a database of barcode sequence fragments that may be included in the nucleic acid construct of the control composition.

54. A sequencing control composition, said control composition comprising a nucleic acid construct comprising at least one barcode sequence fragment, at least one universal sequence fragment, and at least one GC content fragment.

55. The control composition of clause 54 wherein one or more of the GC content fragments has a GC content of about 1 to about 40 percent.

56. The control composition of clause 54 wherein one or more of the GC content fragments has a GC content of about 40 to about 60 percent.
57. The control composition of clause 54 wherein one or more of the GC content fragments has a GC content of about 60 to about 100 percent.
58. The control composition of any one of clauses 54 to 57 comprising nucleic acid constructs with GC content fragments with at least two different percent GC contents.
59. The control composition of any one of clauses 54 to 58 comprising nucleic acid constructs with GC content fragments with at least three different percent GC contents.
60. The control composition of any one of clauses 54 to 59 comprising nucleic acid constructs with GC content fragments with at least four different percent GC contents.
61. The control composition of clause 59 wherein the percent GC contents are about 1 to about 40 percent, about 40 percent to about 60 percent, and about 60 percent to about 100 percent.
62. The control composition of any one of clauses 54 to 61 wherein the control composition is used to determine if cross-contamination between samples for sequencing has occurred.
63. The control composition of any one of clauses 54 to 62 wherein the control composition is used to determine if sample swapping has occurred.
64. The control composition of any one of clauses 54 to 63 wherein the GC content fragment is used to control for polymerase, transposase, ligase, or repair enzyme GC content bias.
65. The control composition of any one of clauses 54 to 64 wherein the control composition is used for quantification of nucleic acids during sequencing.
66. The control composition of any one of clauses 54 to 65 wherein the nucleic acid construct is a deoxyribonucleic acid construct.
67. The control composition of any one of clauses 54 to 66 wherein the nucleic acid construct comprises at least a first and a second universal sequence fragment.
68. The control composition of clause 67 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.
69. The control composition of any one of clauses 67 to 68 wherein the nucleic acid construct further comprises at least a first and a second primer binding site fragment.
70. The control composition of clause 69 wherein the first primer binding site fragment is linked at its 3' end to the 5' end of the first universal sequence fragment and the second primer binding site fragment is linked at its 5' end to the 3' end of the second universal sequence fragment.
71. The control composition of any one of clauses 69 to 70 wherein the primer binding site fragments range in length from about 15 base pairs to about 30 base pairs.
72. The control composition of any one of clauses 54 to 71 wherein the nucleic acid construct ranges in length from about 80 base pairs to about 300 base pairs.
73. The control composition of any one of clauses 54 to 68 wherein the sequencing is whole genome sequencing.
74. The control composition of any one of clauses 69 to 72 wherein the sequencing is amplicon sequencing.
75. The control composition of any one of clauses 54 to 74 wherein the sequencing is Next Generation Sequencing.
76. The control composition of any one of clauses 54 to 75 wherein the nucleic acid construct is encapsulated.
77. The control composition of clause 76 wherein the nucleic acid construct is encapsulated in a liposome.
78. The control composition of clause 77 wherein the liposome comprises a lipid selected from the group consisting of cholesterol, a lipopolysaccharide, a peptidoglycan, a PEG, a teichoic acid, a phospholipid, and combinations thereof.
79. The control composition of any one of clauses 54 to 78 wherein the barcode sequence fragment comprises a unique sequence not present in any known genome.
80. The control composition of any one of clauses 54 to 75 wherein the nucleic acid construct is incorporated into the genome of a microorganism.
81. The control composition of any one of clauses 74 to 79 wherein the nucleic acid construct is incorporated into a plasmid.
82. A kit comprising the control composition of any one of clauses 54 to 81.
83. The kit of clause 82 further comprising a reagent for nucleic acid extraction.
84. The kit of clause 82 or 83 further comprising a reagent for nucleic acid purification.
85. The kit of any one of clauses 82 to 84 further comprising a reagent for library preparation.
86. The kit of any one of clauses 82 to 85 further comprising a probe.
87. The kit of any one of clauses 82 to 86 further comprising a reagent for sequencing.
88. The kit of any one of clauses 82 to 87 wherein the kit comprises more than one control composition of any one of clauses 54 to 81 wherein each control composition comprises a different nucleic acid construct wherein the different nucleic acid constructs comprise different barcode sequence fragments.
89. The kit of any one of clauses 82 to 88 wherein the kit comprises more than one control composition of any one of clauses 54 to 81 and wherein the nucleic acid construct in each control composition is encapsulated in a different type of liposome.
90. A method for monitoring sample cross-contamination and/or sample swapping and for quantification of nucleic acids during sequencing, the method comprising,
a) extracting DNA from a sample;
b) purifying the DNA;
c) spiking the sample, after DNA extraction and purification and before library preparation, with a control composition comprising a nucleic acid construct wherein the nucleic acid construct comprises at least one barcode sequence fragment, at least one universal sequence fragment, and at least one GC content fragment, and wherein the nucleic acid construct is a deoxyribonucleic acid construct, wherein total DNA is obtained after spiking the sample, and wherein total DNA comprises the DNA from the sample and the DNA from the nucleic acid construct;

d) preparing a library from total DNA;
e) sequencing total DNA; and
f) detecting and quantifying the nucleic acid construct in total DNA.

91. A method for monitoring sample cross-contamination and/or sample swapping and for quantification of nucleic acids during sequencing, the method comprising,
   a) spiking a sample with a control composition comprising a nucleic acid construct wherein the nucleic acid construct comprises at least one barcode sequence fragment, at least one universal sequence fragment, and at least one GC content fragment and wherein the nucleic acid construct is a deoxyribonucleic acid construct;
   b) extracting total DNA from the sample wherein total DNA comprises the DNA from the sample and the DNA from the nucleic acid construct;
   c) purifying total DNA;
   d) preparing a library from total DNA;
   e) sequencing total DNA; and
   f) detecting and quantifying the nucleic acid construct in total DNA.

92. The method of clause 91 wherein sample cross-contamination and/or sample swapping can be monitored over all steps of a DNA sequencing protocol including collection of the sample, extraction of total DNA, purification of the extracted total DNA, library preparation, and sequencing.

93. The method of any one of clauses 90 to 92 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.

94. The method of any one of clauses 90 to 93 wherein the step of preparing the library from total DNA comprises a step of amplifying the nucleic acid construct.

95. The method of any one of clauses 90 to 94 wherein one of the GC content fragments has a GC content of about 1 to about 40 percent.

96. The method of any one of clauses 90 to 94 wherein one of the GC content fragments has a GC content of about 40 to about 60 percent.

97. The method of any one of clauses 90 to 94 wherein one of the GC content fragments has a GC content of about 60 to about 100 percent.

98. The method of any one of clauses 90 to 97 wherein the control composition comprises nucleic acid constructs with GC content fragments with at least two different percent GC contents.

99. The method of any one of clauses 90 to 98 wherein the control composition comprises nucleic acid constructs with GC content fragments with at least three different percent GC contents.

100. The method of any one of clauses 90 to 99 wherein the control composition comprises nucleic acid constructs with GC content fragments with at least four different percent GC contents.

101. The method of clause 99 wherein the GC contents are about 1 to about 40 percent, about 40 percent to about 60 percent, and about 60 percent to about 100 percent.

102. The method of any one of clauses 90 to 101 wherein the GC content fragment is used to control for polymerase, transposase, ligase, or repair enzyme GC content bias.

103. The method of any one of clauses 90 to 102 wherein the nucleic acid construct is present at at least two different concentrations for use in generating a standard curve for the quantification of nucleic acids during sequencing.

104. The method of any one of clauses 90 to 103 wherein the nucleic acid construct is present at at least three different concentrations for use in generating a standard curve for the quantification of nucleic acids during sequencing.

105. The method of any one of clauses 90 to 104 wherein the nucleic acid construct is present at at least four different concentrations for use in generating a standard curve for the quantification of nucleic acids during sequencing.

106. The method of any one of clauses 90 to 105 wherein the nucleic acid construct is present at at least five different concentrations for use in generating a standard curve for the quantification of nucleic acids during sequencing.

107. The method of any one of clauses 103 to 106 wherein a different bar code sequence fragment is present in the nucleic acid construct at each of the different concentrations of the nucleic acid construct.

108. The method of clause 107 wherein at each of the different concentrations of the nucleic construct, the control composition comprises multiple nucleic acid constructs with different percent GC contents but with the same barcode sequence fragment for the nucleic acid constructs with different percent GC contents.

109. The method of any one of clauses 90 to 108 wherein the barcode sequence fragment comprises a unique sequence not present in any known genome.

110. The method of any one of clauses 90 to 109 wherein the nucleic acid construct comprises at least a first and a second universal sequence fragment.

111. The method of clause 110 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.

112. The method of any one of clauses 109 to 111 wherein the nucleic acid construct further comprises at least a first and a second primer binding site fragment.

113. The method of clause 112 wherein the first primer binding site fragment is linked at its 3' end to the 5' end of the first universal sequence fragment and the second primer binding site fragment is linked at its 5' end to the 3' end of the second universal sequence fragment.

114. The method of any one of clauses 112 to 113 wherein the primer binding site fragments range in length from about 15 base pairs to about 30 base pairs.

115. The method of any one of clauses 90 to 114 wherein the nucleic acid construct ranges in length from about 80 base pairs to about 300 base pairs.

116. The method of any one of clauses 90 to 111 wherein the sequencing is whole genome sequencing.

117. The method of any one of clauses 112 to 115 wherein the sequencing is amplicon sequencing.
118. The method of any one of clauses 90 to 117 wherein the sequencing is Next Generation Sequencing.
119. The method of any one of clauses 91 to 118 wherein the nucleic acid construct is encapsulated.
120. The method of clause 119 wherein the nucleic acid construct is encapsulated in a liposome.
121. The method of clause 120 wherein the liposome comprises a lipid selected from the group consisting of cholesterol, a lipopolysaccharide, a peptidoglycan, a PEG, a teichoic acid, a phospholipid, and combinations thereof.
122. The method of any one of clauses 119 to 121 wherein more than one type of control composition is used in the method wherein the nucleic acid construct in each type of control composition is encapsulated in a different type of liposome.
123. The method of clause 122 wherein each type of control composition with the nucleic acid construct encapsulated in a different type of liposome comprises a different barcode sequence fragment.
124. The method of any one of clauses 91 to 118 wherein the nucleic acid construct is incorporated into the genome of a microorganism.
125. The method of any one of clauses 117 to 123 wherein the nucleic acid construct is incorporated into a plasmid.
126. The method of any one of clauses 90 to 111 or 119 to 124 wherein the library preparation step further comprises the step of hybridizing the nucleic acid construct to an immobilized probe before sequencing the nucleic acid construct.
127. The method of clause 126 wherein the probe comprises sequences complementary to the universal sequence fragments in the nucleic acid construct and wherein the probe does not hybridize to the barcode sequence fragment in the nucleic acid construct.
128. The method of any one of clauses 90 to 127 wherein detecting and quantifying the nucleic acid construct in total DNA comprises:
   a) identifying each universal sequence fragment in sequencing reads generated by sequencing the total DNA;
   b) identifying the barcode sequence fragment in each sequencing read identified as including a universal sequence fragment; and
   c) counting the number of occurrences of each unique barcode sequence fragment identified in the sequencing reads generated by sequencing the total DNA.
129. The method of clause 128, wherein the identifying steps are performed using a text-matching algorithm.
130. The method of clause 128 or 129 wherein identifying each universal sequence fragment comprises referencing a database of universal sequence fragments that may be included in the nucleic acid construct of the control composition.
131. The method of any one of clauses 128 to 130 wherein identifying the barcode sequence fragment comprises referencing a database of barcode sequence fragments that may be included in the nucleic acid construct of the control composition.
132. The method of any one of clauses 128 to 131 further comprising comparing the number of occurrences of each unique barcode sequence fragment identified in the sequencing reads generated by sequencing the total DNA to a known concentration of the nucleic acid construct comprising that barcode sequence fragment in the control composition that was used to spike the sample.
133. The method of any one of clauses 128 to 132 further comprising determining that cross-contamination or sample swapping has occurred in response to identifying an unexpected barcode sequence fragment in the sequencing reads generated by sequencing the total DNA.
134. The method of any one of clauses 128 to 133 further comprising identifying the GC content fragment in each sequencing read identified as including a universal sequence fragment and counting the number of occurrences of each unique GC content fragment identified in the sequencing reads generated by sequencing the total DNA.
135. The method of clause 134, further comprising comparing the number of occurrences of each unique GC content fragment identified in the sequencing reads generated by sequencing the total DNA to a known concentration of the nucleic acid construct comprising that GC content fragment in the control composition that was used to spike the sample.
136. A chemical analysis control composition, said control composition comprising a nucleic acid construct comprising at least one barcode sequence fragment linked at its 5' or 3' end to at least one universal sequence fragment.
137. The control composition of clause 136 wherein the control composition is used to determine if cross-contamination between samples for chemical analysis has occurred.
138. The control composition of clause 136 wherein the control composition is used to determine if sample swapping has occurred.
139. The control composition of any one of clauses 136 to 138 wherein the nucleic acid construct is a deoxyribonucleic acid construct.
140. The control composition of any one of clauses 136 to 139 wherein the nucleic acid construct comprises at least a first and a second universal sequence fragment.
141. The control composition of clause 140 wherein the first universal sequence fragment is linked to the 5' end of the barcode sequence fragment and the second universal sequence fragment is linked to the 3' end of the barcode sequence fragment.
142. The control composition of any one of clauses 136 to 141 wherein the nucleic acid construct further comprises at least a first and a second primer binding site fragment.
143. The control composition of clause 142 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
144. The control composition of clause 143 wherein the primer binding site fragments range in length from about 15 base pairs to about 30 base pairs.
145. The control composition of clause 143 wherein the nucleic acid construct ranges in length from about 80 base pairs to about 300 base pairs.
146. The control composition of any one of clauses 136 to 145 wherein the chemical analysis is quantitative and/or qualitative.

147. The control composition of any one of clauses 136 to 146 wherein a small molecule is analyzed and the small molecule is an inorganic compound or an organic compound.
148. The control composition of any one of clauses 136 to 147 wherein the chemical analysis is selected from the group consisting of forensic analysis, environmental analysis, industrial analysis, and medical analysis.
149. The control composition of clause 148 wherein the analysis is forensic analysis and the forensic analysis is selected from the group consisting of stomach content analysis, blood alcohol content analysis, substance abuse analysis, toxin analysis, and poison analysis.
150. The control composition of any one of clauses 136 to 149 wherein the chemical analysis is mass spectrometry.
151. The control composition of any one of clauses 136 to 150 wherein the nucleic acid construct is encapsulated.
152. The control composition of clause 151 wherein the nucleic acid construct is encapsulated in a liposome.
153. The control composition of clause 152 wherein the liposome comprises a lipid selected from the group consisting of cholesterol, a lipopolysaccharide, a peptidoglycan, a PEG, a teichoic acid, a phospholipid, and combinations thereof.
154. The control composition of any one of clauses 136 to 153 wherein the barcode sequence fragment comprises a unique sequence not present in any known genome.
155. The control composition of any one of clauses 136 to 154 wherein the nucleic acid construct is incorporated into a plasmid.
156. A kit comprising the control composition of any one of clauses 136 to 155.
157. The kit of clause 156 further comprising a reagent for nucleic acid extraction.
158. The kit of clause 156 or 157 further comprising a reagent for nucleic acid purification.
159. The kit of any one of clauses 156 to 158 further comprising a reagent for library preparation.
160. The kit of any one of clauses 156 to 159 further comprising a probe.
161. The kit of any one of clauses 156 to 160 further comprising a reagent for sequencing.
162. A method for monitoring cross-contamination or sample swapping during an analytical chemistry protocol, the method comprising,
   a) spiking an analytical chemistry protocol sample with a control composition comprising a nucleic acid construct wherein the nucleic acid construct comprises at least one barcode sequence fragment linked to at least one universal sequence fragment and wherein the nucleic acid construct is a deoxyribonucleic acid construct;
   b) performing the analytical chemistry protocol;
   c) archiving a sample from the analytical chemistry protocol;
   d) extracting total DNA from the archived sample wherein total DNA comprises the DNA from the nucleic acid construct and DNA from the analytical chemistry protocol sample, if any;
   e) purifying total DNA;
   f) preparing a library from total DNA;
   g) sequencing the extracted, purified total DNA; and
   h) detecting the nucleic acid construct in total DNA.
163. The method of clause 162 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
164. The method of clause 162 or 163 wherein the method is used to determine if cross-contamination between samples has occurred.
165. The method of clause 162 or 163 wherein the method is used to determine if sample swapping has occurred.
166. The method of any one of clauses 162 to 165 wherein the step of preparing the library from total DNA comprises a step of amplifying the nucleic acid construct.
167. The method of any one of clauses 162 to 166 wherein the nucleic acid construct comprises at least a first and a second universal sequence fragment.
168. The method of clause 167 wherein the first universal sequence fragment is linked to the 5' end of the barcode sequence fragment and the second universal sequence fragment is linked to the 3' end of the barcode sequence fragment.
169. The method of any one of clauses 162 to 168 wherein the nucleic acid construct further comprises at least a first and a second primer binding site fragment.
170. The method of clause 169 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
171. The method of clause 170 wherein the primer binding site fragments range in length from about 15 base pairs to about 30 base pairs.
172. The method of clause 170 wherein the nucleic acid construct ranges in length from about 80 base pairs to about 300 base pairs.
173. The method of any one of clauses 162 to 172 wherein the nucleic acid construct is encapsulated.
174. The method of clause 173 wherein the nucleic acid construct is encapsulated in a liposome.
175. The method of clause 174 wherein the liposome comprises a lipid selected from the group consisting of cholesterol, a lipopolysaccharide, a peptidoglycan, a PEG, a teichoic acid, a phospholipid, and combinations thereof.
176. The method of any one of clauses 162 to 175 wherein the barcode sequence fragment comprises a unique sequence not present in any known genome.
177. The method of any one of clauses 162 to 176 wherein the nucleic acid construct is incorporated into a plasmid.
178. The method of any one of clauses 162 to 177 wherein the chemical analysis is quantitative and/or qualitative.
179. The method of any one of clauses 162 to 178 wherein a small molecule is analyzed and the small molecule is an inorganic compound or an organic compound.
180. The method of any one of clauses 162 to 179 wherein the chemical analysis is selected from the group consisting of forensic analysis, environmental analysis, industrial analysis, and medical analysis.

181. The method of clause 180 wherein the analysis is forensic analysis and the forensic analysis is selected from the group consisting of stomach content analysis, blood alcohol content analysis, substance abuse analysis, toxin analysis, and poison analysis, or combinations thereof.

182. The method of any one of clauses 162 to 180 wherein the analytical chemistry protocol is mass spectrometry.

183. The method of any one of clauses 162 to 182 wherein detecting the nucleic acid construct in total DNA comprises
    i) identifying the universal sequence fragment in a sequencing read generated by sequencing the extracted, purified total DNA;
    ii) comparing a sequence fragment adjacent the universal sequence fragment in the sequencing read to the barcode sequence fragment; and
    iii) determining that cross-contamination or sample swapping has occurred in response to the sequence fragment adjacent the universal sequence fragment not matching the barcode sequence fragment.

184. The method of any one of clauses 167 to 182 wherein detecting the nucleic acid construct in total DNA comprises
    iv) identifying the first and second universal sequence fragments in a sequencing read generated by sequencing the extracted, purified total DNA;
    v) comparing a sequence fragment located between the first and second universal sequence fragments in the sequencing read to the barcode sequence fragment; and
    vi) determining that cross-contamination or sample swapping has occurred in response to the sequence fragment located between the first and second universal sequence fragments not matching the barcode sequence fragment.

185. The method of clause 183 or 184, wherein the identifying and comparing steps are performed using a text-matching algorithm.

186. The method of any one of clauses 183 to 185 wherein the identifying step comprises referencing a database of universal sequence fragments that may be included in the nucleic acid construct of the control composition.

187. The method of any one of clauses 183 to 186 wherein the comparing step comprises referencing a database of barcode sequence fragments that may be included in the nucleic acid construct of the control composition.

BRIEF DESCRIPTION OF THE DRAWINGS

FIG. 4 shows the sequencing results for soil samples in which CCC-1 DNA and CCC-2 DNA were spiked-in prior to extraction either individually or where CCC-1 DNA and CCC-2 DNA were spiked-in together.

DETAILED DESCRIPTION OF ILLUSTRATIVE EMBODIMENTS

Figure 1:
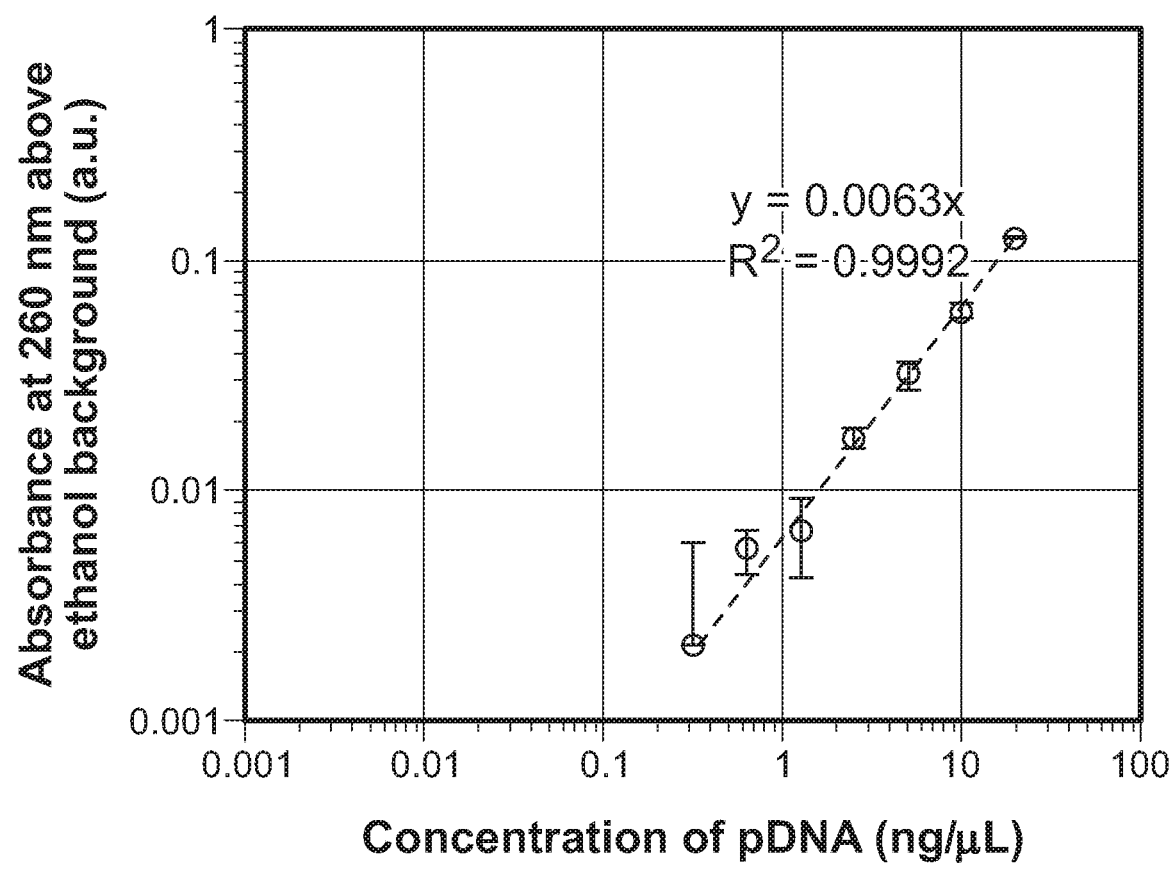
FIG. 1 shows the quantification of CCC DNA (i.e., CCC-1 DNA—for a description see Example 1) via UV absorbance at 260 nm. The curve is linear and CCC DNA (i.e., CCC-1 DNA) can be detected down to a concentration of about 0.3 ng/µL. The absorbance for the sample used in the assays corresponding to FIGS. 2A and B and FIG. 4 was 0.015±0.001. This corresponds to a concentration of ~12±1 ng/µL.

The present invention provides sequencing controls that can be used starting after the extraction step (e.g., by spiking the extract with the control constructs) or in every step of analysis of an unknown test sample (e.g., from nucleic acid extraction to nucleic acid purification to library preparation and sequencing). In one embodiment, nucleic acid constructs comprising a barcode sequence fragment are provided that can be encapsulated in a simulated cell membrane (e.g., a simulated bacterial cell membrane or eukaryotic cell membrane), or embedded directly in the genome of an organism for use as spike-in sequencing controls. In one aspect, the barcode sequence fragment comprises a unique sequence not present in any known genome. In one embodiment, the sequencing controls can be spiked in the unknown test sample prior to or after nucleic acid extraction and then can be detected in the final sequenced samples. In another embodiment, different nucleic acid constructs (i.e., with different barcode sequence fragments) can be spiked in different samples so that cross-contamination of samples or sample swapping can be detected.

In one embodiment, the barcode sequence fragment can be flanked at its 5' or 3' end, or both, by universal sequence fragments. The universal sequence fragments can add length to the nucleic acid construct and can serve as markers for bioinformatic analysis to identify the beginning and end of the barcode sequence fragment after sequencing. In another illustrative aspect, the barcode sequence fragment may be flanked by primer binding site sequence fragments (i.e., directly or indirectly linked to the barcode sequence fragment) so that the nucleic acid construct comprising the barcode sequence fragment can be amplified during an amplicon sequencing protocol. In another embodiment, primer binding site sequence fragments may be lacking for use of the sequencing controls in whole genome sequencing protocols. In another embodiment, a set of different nucleic acid construct spike-ins with different barcode sequence fragments (e.g., 384 or 96 different barcode sequence fragments) can be used to allow for multiplexing of samples on one sequencing run.

In various embodiments, samples with microorganisms containing nucleic acids (e.g., DNA), or samples with other sources of nucleic acids, may be analyzed by sequencing using the control compositions for sequencing described herein. The samples can be, for example, selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, hair, a tissue sample, a soil sample, a water sample, a food sample, an air sample, a plant sample, an industrial waste sample, a surface wipe sample, and an animal sample.

In another embodiment, compositions and methods are provided for the use of spike-in controls that simultaneously 1) control for cross-contamination and/or sample swapping and 2) allow for quantitation while controlling for different GC content samples (e.g., low, balanced, and high GC content) and/or for different lysis efficiencies. In one aspect, barcoded DNA molecules are produced with different GC contents, using GC content fragments, wherein barcode sequence fragments and GC content fragments are flanked by universal sequence fragments, and then the nucleic acid construct can be encapsulated in a simulated cell membrane. By using the same type of nucleic acid construct, but with different barcode sequence fragments, different quantities of the encapsulated or unencapsulated nucleic acid construct can be spiked-in, and a standard curve for quantitation can be produced. In this embodiment, the barcode sequence fragments can be used to verify that no cross-contamination or sample swapping occurred during sample preparation or processing. In this quantitation embodiment, the different GC content fragments (e.g., low, balanced, and high GC content) have the same barcode sequence fragment at each GC percentage (e.g., low, balanced, and high GC content), but at each separate concentration of the nucleic acid construct used to produce the standard curve, the barcode sequence fragments are unique to each concentration used to produce the standard curve. In this embodiment, the encapsulation method can also be varied to control for different resistances to lysis to mimic, for example, Gram-positive bacterial cell walls, Gram-negative bacterial cell walls, and fungal cell walls. In this encapsulation embodiment, the type of encapsulation method can be correlated to a unique barcode sequence fragment in the nucleic acid construct to enable differentiation post sequencing.

In one embodiment, the nucleic acid construct can be constructed (5' to 3') with a universal sequence fragment, a unique barcode sequence fragment, a GC content fragment (e.g., with high, balanced, or low GC content), and a second universal sequence fragment. In this embodiment, the unique barcode sequence fragment is a sequence that is not present in any known genome. An exemplary GC content fragment can contain about 60 to about 100 percent GC content for high GC content, about 40 to about 60 percent GC content for balanced GC content, and about 1 to about 40 percent GC content for low GC content. In this embodiment, the universal sequence fragments can add length to the nucleic acid construct and can serve as markers for bioinformatic analysis to identify the beginning and end of the nucleic acid construct after sequencing. In alternate embodiments, the universal sequence fragments could be extended as needed to make the total nucleic acid construct longer for different applications such as long read sequencing. In various embodiments, the nucleic acid constructs can either be encapsulated to spike into samples at sample collection and control for full sample preparation and processing or can be unencapsulated and can be spiked in after extraction to control for library preparation. In one aspect, two or more mixtures of three different GC content fragment constructs can be prepared (e.g., a low quantity standard and a high quantity standard with each having a unique barcode sequence fragment so that the high and low quantity standards can be differentiated post-sequencing).

In yet another embodiment, spike-in cross-contamination and sample swapping controls for analytical chemistry analysis of unknown materials are provided. These controls can be used in analytical chemistry procedures, such as mass spectrometry, and any of the nucleic acid constructs described herein can be used.

The following clauses, and combinations thereof, provide various additional illustrative aspects of the invention described herein. The various embodiments described in any other section of this patent application, including the summary portion of the section titled "BACKGROUND AND SUMMARY", the "EXAMPLES", and this "DETAILED DESCRIPTION OF ILLUSTRATIVE EMBODIMENTS" section of the application are applicable to any of the following embodiments of the invention described in the numbered clauses below.

1. A sequencing control composition, said control composition comprising a nucleic acid construct comprising at least one barcode sequence fragment linked at its 5' or 3' end to at least one universal sequence fragment.
2. The control composition of clause 1 wherein the control composition is used to determine if cross-contamination between samples for sequencing has occurred.
3. The control composition of clause 1 wherein the control composition is used to determine if sample swapping has occurred.
4. The control composition of any one of clauses 1 to 3 wherein the nucleic acid construct is a deoxyribonucleic acid construct.
5. The control composition of any one of clauses 1 to 4 wherein the nucleic acid construct comprises at least a first and a second universal sequence fragment.
6. The control composition of clause 5 wherein the first universal sequence fragment is linked to the 5' end of the barcode sequence fragment and the second universal sequence fragment is linked to the 3' end of the barcode sequence fragment.
7. The control composition of any one of clauses 1 to 6 wherein the nucleic acid construct further comprises at least a first and a second primer binding site fragment.
8. The control composition of clause 6 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
9. The control composition of clause 8 wherein the primer binding site fragments range in length from about 15 base pairs to about 30 base pairs.
10. The control composition of clause 8 wherein the nucleic acid construct ranges in length from about 80 base pairs to about 300 base pairs.
11. The control composition of any one of clauses 1 to 6 wherein the sequencing is whole genome sequencing.
12. The control composition of any one of clauses 7 to 10 wherein the sequencing is amplicon sequencing.
13. The control composition of any one of clauses 1 to 12 wherein the sequencing is Next Generation Sequencing.
14. The control composition of any one of clauses 1 to 13 wherein the nucleic acid construct is encapsulated.
15. The control composition of clause 14 wherein the nucleic acid construct is encapsulated in a liposome.
16. The control composition of clause 15 wherein the liposome comprises a lipid selected from the group consisting of cholesterol, a lipopolysaccharide, a peptidoglycan, a PEG, a teichoic acid, a phospholipid, and combinations thereof.
17. The control composition of any one of clauses 1 to 13 wherein the nucleic acid construct is incorporated into the genome of a microorganism.
18. The control composition of any one of clauses 1 to 17 wherein the barcode sequence fragment comprises a unique sequence not present in any known genome.
19. The control composition of any one of clauses 12 to 16 wherein the nucleic acid construct is incorporated into a plasmid.
20. A kit comprising the control composition of any one of clauses 1 to 19.
21. The kit of clause 20 further comprising a reagent for nucleic acid extraction.
22. The kit of clause 20 or 21 further comprising a reagent for nucleic acid purification.
23. The kit of any one of clauses 20 to 22 further comprising a reagent for library preparation.
24. The kit of any one of clauses 20 to 23 further comprising a probe.
25. The kit of any one of clauses 20 to 24 further comprising a reagent for sequencing.
26. The kit of any one of clauses 20 to 25 wherein the kit comprises more than one control composition of any one of clauses 1 to 19 wherein each control composition comprises a different nucleic acid construct wherein the different nucleic acid constructs comprise different barcode sequence fragments.
27. A method for monitoring cross-contamination or sample swapping over all steps of a DNA sequencing protocol including collection of a sample comprising DNA, DNA extraction from the sample, purification of the extracted DNA, library preparation, and sequencing, the method comprising,
    a) spiking the sample with a control composition comprising a nucleic acid construct wherein the nucleic acid construct comprises at least one barcode sequence fragment linked to at least one universal sequence fragment and wherein the nucleic acid construct is a deoxyribonucleic acid construct;

b) extracting total DNA wherein total DNA comprises the DNA from the sample and DNA from the nucleic acid construct;
c) purifying total DNA;
d) preparing a library from total DNA;
e) sequencing the extracted, purified total DNA; and
f) detecting the nucleic acid construct in total DNA.

28. The method of clause 27 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.

29. The method of clause 27 or 28 wherein the method is used to determine if cross-contamination between samples has occurred.

30. The method of clause 27 or 28 wherein the method is used to determine if sample swapping has occurred.

31. The method of any one of clauses 27 to 30 wherein the step of preparing the library from total DNA comprises a step of amplifying the nucleic acid construct.

32. The method of any one of clauses 27 to 31 wherein the nucleic acid construct comprises at least a first and a second universal sequence fragment.

33. The method of clause 32 wherein the first universal sequence fragment is linked to the 5' end of the barcode sequence fragment and the second universal sequence fragment is linked to the 3' end of the barcode sequence fragment.

34. The method of any one of clauses 27 to 33 wherein the nucleic acid construct further comprises at least a first and a second primer binding site fragment.

35. The method of clause 34 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.

36. The method of clause 35 wherein the primer binding site fragments range in length from about 15 base pairs to about 30 base pairs.

37. The method of clause 35 wherein the nucleic acid construct ranges in length from about 80 base pairs to about 300 base pairs.

38. The method of any one of clauses 27 to 33 wherein the sequencing is whole genome sequencing.

39. The method of any one of clauses 34 to 37 wherein the sequencing is amplicon sequencing.

40. The method of any one of clauses 27 to 39 wherein the sequencing is Next Generation Sequencing.

41. The method of any one of clauses 27 to 40 wherein the nucleic acid construct is encapsulated.

42. The method of clause 41 wherein the nucleic acid construct is encapsulated in a liposome.

43. The method of clause 42 wherein the liposome comprises a lipid selected from the group consisting of cholesterol, a lipopolysaccharide, a peptidoglycan, a PEG, a teichoic acid, a phospholipid, and combinations thereof.

44. The method of any one of clauses 27 to 40 wherein the nucleic acid construct is incorporated into the genome of a microorganism.

45. The method of any one of clauses 27 to 44 wherein the barcode sequence fragment comprises a unique sequence not present in any known genome.

46. The method of any one of clauses 39 to 43 wherein the nucleic acid construct is incorporated into a plasmid.

47. The method of any one of clauses 26 to 33 or 41 to 45 wherein the library preparation step further comprises the step of hybridizing the nucleic acid construct to an immobilized probe before sequencing the nucleic acid construct.

48. The method of clause 47 wherein the probe comprises sequences complementary to the universal sequence fragments in the nucleic acid construct and wherein the probe does not hybridize to the barcode sequence fragment in the nucleic acid construct.

49. The method of any one of clauses 27 to 48 wherein detecting the nucleic acid construct in total DNA comprises
   iv) identifying the universal sequence fragment in a sequencing read generated by sequencing the extracted, purified total DNA;
   v) comparing a sequence fragment adjacent the universal sequence fragment in the sequencing read to the barcode sequence fragment; and
   vi) determining that cross-contamination or sample swapping has occurred in response to the sequence fragment adjacent the universal sequence fragment not matching the barcode sequence fragment.

50. The method of any one of clauses 32 to 48 wherein detecting the nucleic acid construct in total DNA comprises
   vii) identifying the first and second universal sequence fragments in a sequencing read generated by sequencing the extracted, purified total DNA;
   viii) comparing a sequence fragment located between the first and second universal sequence fragments in the sequencing read to the barcode sequence fragment; and
   ix) determining that cross-contamination or sample swapping has occurred in response to the sequence fragment located between the first and second universal sequence fragments not matching the barcode sequence fragment.

51. The method of clause 49 or 50, wherein the identifying and comparing steps are performed using a text-matching algorithm.

52. The method of any one of clauses 49 to 51 wherein the identifying step comprises referencing a database of universal sequence fragments that may be included in the nucleic acid construct of the control composition.

53. The method of any one of clauses 49 to 52 wherein the comparing step comprises referencing a database of barcode sequence fragments that may be included in the nucleic acid construct of the control composition.

54. A sequencing control composition, said control composition comprising a nucleic acid construct comprising at least one barcode sequence fragment, at least one universal sequence fragment, and at least one GC content fragment.

55. The control composition of clause 54 wherein one or more of the GC content fragments has a GC content of about 1 to about 40 percent.
56. The control composition of clause 54 wherein one or more of the GC content fragments has a GC content of about 40 to about 60 percent.
57. The control composition of clause 54 wherein one or more of the GC content fragments has a GC content of about 60 to about 100 percent.
58. The control composition of any one of clauses 54 to 57 comprising nucleic acid constructs with GC content fragments with at least two different percent GC contents.
59. The control composition of any one of clauses 54 to 58 comprising nucleic acid constructs with GC content fragments with at least three different percent GC contents.
60. The control composition of any one of clauses 54 to 59 comprising nucleic acid constructs with GC content fragments with at least four different percent GC contents.
61. The control composition of clause 59 wherein the percent GC contents are about 1 to about 40 percent, about 40 percent to about 60 percent, and about 60 percent to about 100 percent.
62. The control composition of any one of clauses 54 to 61 wherein the control composition is used to determine if cross-contamination between samples for sequencing has occurred.
63. The control composition of any one of clauses 54 to 62 wherein the control composition is used to determine if sample swapping has occurred.
64. The control composition of any one of clauses 54 to 63 wherein the GC content fragment is used to control for polymerase, transposase, ligase, or repair enzyme GC content bias.
65. The control composition of any one of clauses 54 to 64 wherein the control composition is used for quantification of nucleic acids during sequencing.
66. The control composition of any one of clauses 54 to 65 wherein the nucleic acid construct is a deoxyribonucleic acid construct.
67. The control composition of any one of clauses 54 to 66 wherein the nucleic acid construct comprises at least a first and a second universal sequence fragment.
68. The control composition of clause 67 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.
69. The control composition of any one of clauses 67 to 68 wherein the nucleic acid construct further comprises at least a first and a second primer binding site fragment.
70. The control composition of clause 69 wherein the first primer binding site fragment is linked at its 3' end to the 5' end of the first universal sequence fragment and the second primer binding site fragment is linked at its 5' end to the 3' end of the second universal sequence fragment.
71. The control composition of any one of clauses 69 to 70 wherein the primer binding site fragments range in length from about 15 base pairs to about 30 base pairs.
72. The control composition of any one of clauses 54 to 71 wherein the nucleic acid construct ranges in length from about 80 base pairs to about 300 base pairs.
73. The control composition of any one of clauses 54 to 68 wherein the sequencing is whole genome sequencing.
74. The control composition of any one of clauses 69 to 72 wherein the sequencing is amplicon sequencing.
75. The control composition of any one of clauses 54 to 74 wherein the sequencing is Next Generation Sequencing.
76. The control composition of any one of clauses 54 to 75 wherein the nucleic acid construct is encapsulated.
77. The control composition of clause 76 wherein the nucleic acid construct is encapsulated in a liposome.
78. The control composition of clause 77 wherein the liposome comprises a lipid selected from the group consisting of cholesterol, a lipopolysaccharide, a peptidoglycan, a PEG, a teichoic acid, a phospholipid, and combinations thereof.
79. The control composition of any one of clauses 54 to 78 wherein the barcode sequence fragment comprises a unique sequence not present in any known genome.
80. The control composition of any one of clauses 54 to 75 wherein the nucleic acid construct is incorporated into the genome of a microorganism.
81. The control composition of any one of clauses 74 to 79 wherein the nucleic acid construct is incorporated into a plasmid.
82. A kit comprising the control composition of any one of clauses 54 to 81.
83. The kit of clause 82 further comprising a reagent for nucleic acid extraction.
84. The kit of clause 82 or 83 further comprising a reagent for nucleic acid purification.
85. The kit of any one of clauses 82 to 84 further comprising a reagent for library preparation.
86. The kit of any one of clauses 82 to 85 further comprising a probe.
87. The kit of any one of clauses 82 to 86 further comprising a reagent for sequencing.
88. The kit of any one of clauses 82 to 87 wherein the kit comprises more than one control composition of any one of clauses 54 to 81 wherein each control composition comprises a different nucleic acid construct wherein the different nucleic acid constructs comprise different barcode sequence fragments.
89. The kit of any one of clauses 82 to 88 wherein the kit comprises more than one control composition of any one of clauses 54 to 81 and wherein the nucleic acid construct in each control composition is encapsulated in a different type of liposome.
90. A method for monitoring sample cross-contamination and/or sample swapping and for quantification of nucleic acids during sequencing, the method comprising,
   a) extracting DNA from a sample;
   b) purifying the DNA;
   c) spiking the sample, after DNA extraction and purification and before library preparation, with a control composition comprising a nucleic acid construct wherein the nucleic acid construct comprises at least one barcode sequence fragment, at least one universal sequence fragment, and at least one GC content fragment, and wherein the nucleic acid construct is a deoxyribonucleic acid construct, wherein total DNA is obtained after spiking the sample, and wherein total DNA comprises the DNA from the sample and the DNA from the nucleic acid construct;
d) preparing a library from total DNA;
e) sequencing total DNA; and
f) detecting and quantifying the nucleic acid construct in total DNA.

91. A method for monitoring sample cross-contamination and/or sample swapping and for quantification of nucleic acids during sequencing, the method comprising,
a) spiking a sample with a control composition comprising a nucleic acid construct wherein the nucleic acid construct comprises at least one barcode sequence fragment, at least one universal sequence fragment, and at least one GC content fragment and wherein the nucleic acid construct is a deoxyribonucleic acid construct;
b) extracting total DNA from the sample wherein total DNA comprises the DNA from the sample and the DNA from the nucleic acid construct;
c) purifying total DNA;
d) preparing a library from total DNA;
e) sequencing total DNA; and
f) detecting and quantifying the nucleic acid construct in total DNA.

92. The method of clause 91 wherein sample cross-contamination and/or sample swapping can be monitored over all steps of a DNA sequencing protocol including collection of the sample, extraction of total DNA, purification of the extracted total DNA, library preparation, and sequencing.

93. The method of any one of clauses 90 to 92 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.

94. The method of any one of clauses 90 to 93 wherein the step of preparing the library from total DNA comprises a step of amplifying the nucleic acid construct.

95. The method of any one of clauses 90 to 94 wherein one of the GC content fragments has a GC content of about 1 to about 40 percent.

96. The method of any one of clauses 90 to 94 wherein one of the GC content fragments has a GC content of about 40 to about 60 percent.

97. The method of any one of clauses 90 to 94 wherein one of the GC content fragments has a GC content of about 60 to about 100 percent.

98. The method of any one of clauses 90 to 97 wherein the control composition comprises nucleic acid constructs with GC content fragments with at least two different percent GC contents.

99. The method of any one of clauses 90 to 98 wherein the control composition comprises nucleic acid constructs with GC content fragments with at least three different percent GC contents.

100. The method of any one of clauses 90 to 99 wherein the control composition comprises nucleic acid constructs with GC content fragments with at least four different percent GC contents.

101. The method of clause 99 wherein the GC contents are about 1 to about 40 percent, about percent to about 60 percent, and about 60 percent to about 100 percent.

102. The method of any one of clauses 90 to 101 wherein the GC content fragment is used to control for polymerase, transposase, ligase, or repair enzyme GC content bias.

103. The method of any one of clauses 90 to 102 wherein the nucleic acid construct is present at at least two different concentrations for use in generating a standard curve for the quantification of nucleic acids during sequencing.

104. The method of any one of clauses 90 to 103 wherein the nucleic acid construct is present at at least three different concentrations for use in generating a standard curve for the quantification of nucleic acids during sequencing.

105. The method of any one of clauses 90 to 104 wherein the nucleic acid construct is present at at least four different concentrations for use in generating a standard curve for the quantification of nucleic acids during sequencing.

106. The method of any one of clauses 90 to 105 wherein the nucleic acid construct is present at at least five different concentrations for use in generating a standard curve for the quantification of nucleic acids during sequencing.

107. The method of any one of clauses 103 to 106 wherein a different bar code sequence fragment is present in the nucleic acid construct at each of the different concentrations of the nucleic acid construct.

108. The method of clause 107 wherein at each of the different concentrations of the nucleic construct, the control composition comprises multiple nucleic acid constructs with different percent GC contents but with the same barcode sequence fragment for the nucleic acid constructs with different percent GC contents.

109. The method of any one of clauses 90 to 108 wherein the barcode sequence fragment comprises a unique sequence not present in any known genome.

110. The method of any one of clauses 90 to 109 wherein the nucleic acid construct comprises at least a first and a second universal sequence fragment.

111. The method of clause 110 wherein the first universal sequence fragment is linked to the 5' end of the barcode sequence fragment, the barcode sequence fragment is between the first universal sequence fragment and the GC content fragment, and the second universal sequence fragment is linked to the 3' end of the GC content fragment.

112. The method of any one of clauses 109 to 111 wherein the nucleic acid construct further comprises at least a first and a second primer binding site fragment.

113. The method of clause 112 wherein the first primer binding site fragment is linked at its 3' end to the 5' end of the first universal sequence fragment and the second primer binding site fragment is linked at its 5' end to the 3' end of the second universal sequence fragment.

114. The method of any one of clauses 112 to 113 wherein the primer binding site fragments range in length from about 15 base pairs to about 30 base pairs.

115. The method of any one of clauses 90 to 114 wherein the nucleic acid construct ranges in length from about 80 base pairs to about 300 base pairs.

116. The method of any one of clauses 90 to 111 wherein the sequencing is whole genome sequencing.
117. The method of any one of clauses 112 to 115 wherein the sequencing is amplicon sequencing.
118. The method of any one of clauses 90 to 117 wherein the sequencing is Next Generation Sequencing.
119. The method of any one of clauses 91 to 118 wherein the nucleic acid construct is encapsulated.
120. The method of clause 119 wherein the nucleic acid construct is encapsulated in a liposome.
121. The method of clause 120 wherein the liposome comprises a lipid selected from the group consisting of cholesterol, a lipopolysaccharide, a peptidoglycan, a PEG, a teichoic acid, a phospholipid, and combinations thereof.
122. The method of any one of clauses 119 to 121 wherein more than one type of control composition is used in the method wherein the nucleic acid construct in each type of control composition is encapsulated in a different type of liposome.
123. The method of clause 122 wherein each type of control composition with the nucleic acid construct encapsulated in a different type of liposome comprises a different barcode sequence fragment.
124. The method of any one of clauses 91 to 118 wherein the nucleic acid construct is incorporated into the genome of a microorganism.
125. The method of any one of clauses 117 to 123 wherein the nucleic acid construct is incorporated into a plasmid.
126. The method of any one of clauses 90 to 111 or 119 to 124 wherein the library preparation step further comprises the step of hybridizing the nucleic acid construct to an immobilized probe before sequencing the nucleic acid construct.
127. The method of clause 126 wherein the probe comprises sequences complementary to the universal sequence fragments in the nucleic acid construct and wherein the probe does not hybridize to the barcode sequence fragment in the nucleic acid construct.
128. The method of any one of clauses 90 to 127 wherein detecting and quantifying the nucleic acid construct in total DNA comprises:
   a) identifying each universal sequence fragment in sequencing reads generated by sequencing the total DNA;
   b) identifying the barcode sequence fragment in each sequencing read identified as including a universal sequence fragment; and
   c) counting the number of occurrences of each unique barcode sequence fragment identified in the sequencing reads generated by sequencing the total DNA.
129. The method of clause 128, wherein the identifying steps are performed using a text-matching algorithm.
130. The method of clause 128 or 129 wherein identifying each universal sequence fragment comprises referencing a database of universal sequence fragments that may be included in the nucleic acid construct of the control composition.
131. The method of any one of clauses 128 to 130 wherein identifying the barcode sequence fragment comprises referencing a database of barcode sequence fragments that may be included in the nucleic acid construct of the control composition.
132. The method of any one of clauses 128 to 131 further comprising comparing the number of occurrences of each unique barcode sequence fragment identified in the sequencing reads generated by sequencing the total DNA to a known concentration of the nucleic acid construct comprising that barcode sequence fragment in the control composition that was used to spike the sample.
133. The method of any one of clauses 128 to 132 further comprising determining that cross-contamination or sample swapping has occurred in response to identifying an unexpected barcode sequence fragment in the sequencing reads generated by sequencing the total DNA.
134. The method of any one of clauses 128 to 133 further comprising identifying the GC content fragment in each sequencing read identified as including a universal sequence fragment and counting the number of occurrences of each unique GC content fragment identified in the sequencing reads generated by sequencing the total DNA.
135. The method of clause 134, further comprising comparing the number of occurrences of each unique GC content fragment identified in the sequencing reads generated by sequencing the total DNA to a known concentration of the nucleic acid construct comprising that GC content fragment in the control composition that was used to spike the sample.
136. A chemical analysis control composition, said control composition comprising a nucleic acid construct comprising at least one barcode sequence fragment linked at its 5' or 3' end to at least one universal sequence fragment.
137. The control composition of clause 136 wherein the control composition is used to determine if cross-contamination between samples for chemical analysis has occurred.
138. The control composition of clause 136 wherein the control composition is used to determine if sample swapping has occurred.
139. The control composition of any one of clauses 136 to 138 wherein the nucleic acid construct is a deoxyribonucleic acid construct.
140. The control composition of any one of clauses 136 to 139 wherein the nucleic acid construct comprises at least a first and a second universal sequence fragment.
141. The control composition of clause 140 wherein the first universal sequence fragment is linked to the 5' end of the barcode sequence fragment and the second universal sequence fragment is linked to the 3' end of the barcode sequence fragment.
142. The control composition of any one of clauses 136 to 141 wherein the nucleic acid construct further comprises at least a first and a second primer binding site fragment.
143. The control composition of clause 142 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
144. The control composition of clause 143 wherein the primer binding site fragments range in length from about 15 base pairs to about 30 base pairs.
145. The control composition of clause 143 wherein the nucleic acid construct ranges in length from about 80 base pairs to about 300 base pairs.

146. The control composition of any one of clauses 136 to 145 wherein the chemical analysis is quantitative and/or qualitative.
147. The control composition of any one of clauses 136 to 146 wherein a small molecule is analyzed and the small molecule is an inorganic compound or an organic compound.
148. The control composition of any one of clauses 136 to 147 wherein the chemical analysis is selected from the group consisting of forensic analysis, environmental analysis, industrial analysis, and medical analysis.
149. The control composition of clause 148 wherein the analysis is forensic analysis and the forensic analysis is selected from the group consisting of stomach content analysis, blood alcohol content analysis, substance abuse analysis, toxin analysis, and poison analysis.
150. The control composition of any one of clauses 136 to 149 wherein the chemical analysis is mass spectrometry.
151. The control composition of any one of clauses 136 to 150 wherein the nucleic acid construct is encapsulated.
152. The control composition of clause 151 wherein the nucleic acid construct is encapsulated in a liposome.
153. The control composition of clause 152 wherein the liposome comprises a lipid selected from the group consisting of cholesterol, a lipopolysaccharide, a peptidoglycan, a PEG, a teichoic acid, a phospholipid, and combinations thereof.
154. The control composition of any one of clauses 136 to 153 wherein the barcode sequence fragment comprises a unique sequence not present in any known genome.
155. The control composition of any one of clauses 136 to 154 wherein the nucleic acid construct is incorporated into a plasmid.
156. A kit comprising the control composition of any one of clauses 136 to 155.
157. The kit of clause 156 further comprising a reagent for nucleic acid extraction.
158. The kit of clause 156 or 157 further comprising a reagent for nucleic acid purification.
159. The kit of any one of clauses 156 to 158 further comprising a reagent for library preparation.
160. The kit of any one of clauses 156 to 159 further comprising a probe.
161. The kit of any one of clauses 156 to 160 further comprising a reagent for sequencing.
162. A method for monitoring cross-contamination or sample swapping during an analytical chemistry protocol, the method comprising,
    a) spiking an analytical chemistry protocol sample with a control composition comprising a nucleic acid construct wherein the nucleic acid construct comprises at least one barcode sequence fragment linked to at least one universal sequence fragment and wherein the nucleic acid construct is a deoxyribonucleic acid construct;
    b) performing the analytical chemistry protocol;
    c) archiving a sample from the analytical chemistry protocol;
    d) extracting total DNA from the archived sample wherein total DNA comprises the DNA from the nucleic acid construct and DNA from the analytical chemistry protocol sample, if any;
    e) purifying total DNA;
    f) preparing a library from total DNA;
    g) sequencing the extracted, purified total DNA; and
    h) detecting the nucleic acid construct in total DNA.
163. The method of clause 162 wherein the sample is selected from the group consisting of urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, lymph fluid, whole blood, serum, plasma, a tissue sample, a soil sample, a water sample, a food sample, an air sample, a plant sample, an industrial waste sample, a surface wipe sample, a dust sample, a hair sample, an agricultural sample, and an animal sample.
164. The method of clause 162 or 163 wherein the method is used to determine if cross-contamination between samples has occurred.
165. The method of clause 162 or 163 wherein the method is used to determine if sample swapping has occurred.
166. The method of any one of clauses 162 to 165 wherein the step of preparing the library from total DNA comprises a step of amplifying the nucleic acid construct.
167. The method of any one of clauses 162 to 166 wherein the nucleic acid construct comprises at least a first and a second universal sequence fragment.
168. The method of clause 167 wherein the first universal sequence fragment is linked to the 5' end of the barcode sequence fragment and the second universal sequence fragment is linked to the 3' end of the barcode sequence fragment.
169. The method of any one of clauses 162 to 168 wherein the nucleic acid construct further comprises at least a first and a second primer binding site fragment.
170. The method of clause 169 wherein the nucleic acid construct further comprises at least a first and a second primer binding site fragment and wherein the first primer binding site fragment is linked at its 3' end to the 5' end of the first universal sequence fragment and the second primer binding site fragment is linked at its 5' end to the 3' end of the second universal sequence fragment.
171. The method of clause 170 wherein the primer binding site fragments range in length from about 15 base pairs to about 30 base pairs.
172. The method of clause 170 wherein the nucleic acid construct ranges in length from about 80 base pairs to about 300 base pairs.
173. The method of any one of clauses 162 to 172 wherein the nucleic acid construct is encapsulated.
174. The method of clause 173 wherein the nucleic acid construct is encapsulated in a liposome.
175. The method of clause 174 wherein the liposome comprises a lipid selected from the group consisting of cholesterol, a lipopolysaccharide, a peptidoglycan, a PEG, a teichoic acid, a phospholipid, and combinations thereof.
176. The method of any one of clauses 162 to 175 wherein the barcode sequence fragment comprises a unique sequence not present in any known genome.
177. The method of any one of clauses 162 to 176 wherein the nucleic acid construct is incorporated into a plasmid.
178. The method of any one of clauses 162 to 177 wherein the chemical analysis is quantitative and/or qualitative.
179. The method of any one of clauses 162 to 178 wherein a small molecule is analyzed and the small molecule is an inorganic compound or an organic compound.

180. The method of any one of clauses 162 to 179 wherein the chemical analysis is selected from the group consisting of forensic analysis, environmental analysis, industrial analysis, and medical analysis.
181. The method of clause 180 wherein the analysis is forensic analysis and the forensic analysis is selected from the group consisting of stomach content analysis, blood alcohol content analysis, substance abuse analysis, toxin analysis, and poison analysis, or combinations thereof.
182. The method of any one of clauses 162 to 180 wherein the analytical chemistry protocol is mass spectrometry.
183. The method of any one of clauses 162 to 182 wherein detecting the nucleic acid construct in total DNA comprises
  iv) identifying the universal sequence fragment in a sequencing read generated by sequencing the extracted, purified total DNA;
  v) comparing a sequence fragment adjacent the universal sequence fragment in the sequencing read to the barcode sequence fragment; and
  vi) determining that cross-contamination or sample swapping has occurred in response to the sequence fragment adjacent the universal sequence fragment not matching the barcode sequence fragment.
184. The method of any one of clauses 167 to 182 wherein detecting the nucleic acid construct in total DNA comprises
  x) identifying the first and second universal sequence fragments in a sequencing read generated by sequencing the extracted, purified total DNA;
  xi) comparing a sequence fragment located between the first and second universal sequence fragments in the sequencing read to the barcode sequence fragment; and
  xii) determining that cross-contamination or sample swapping has occurred in response to the sequence fragment located between the first and second universal sequence fragments not matching the barcode sequence fragment.
185. The method of clause 183 or 184, wherein the identifying and comparing steps are performed using a text-matching algorithm.
186. The method of any one of clauses 183 to 185 wherein the identifying step comprises referencing a database of universal sequence fragments that may be included in the nucleic acid construct of the control composition.
187. The method of any one of clauses 183 to 186 wherein the comparing step comprises referencing a database of barcode sequence fragments that may be included in the nucleic acid construct of the control composition.

Control compositions for sequencing or chemical analyses and methods of their use are provided herein. The polymerase chain reaction (PCR) has been developed to analyze nucleic acids in a laboratory. PCR evolved over the last decade into a new generation of devices and methods known as Next Generation Sequencing (NGS). NGS provides faster detection and amplification of nucleic acids at a cheaper price. The NGS devices and methods allow for rapid sequencing as the nucleic acids are amplified in massively parallel, high-throughput platforms.

NGS, and other sequencing methods, for detection of nucleic acids are powerful techniques, for example, for pathogen detection and identification purposes, including for biosurveillance. However, the field suffers from a lack of standards for use in sequencing methods and devices, including NGS methods and devices. Currently, researchers are able to detect and identify nucleic acids from, for example, pathogens through sequencing, but are unable to monitor sample cross-contamination and sample swapping throughout the sequencing protocol. More effective standards are also needed for monitoring sample cross-contamination and sample swapping after the extraction process, and for quantitation of nucleic acids during sequencing.

Analytical chemistry analysis of unknown materials can be confounded by identification of compounds that do not seem to fit with what is expected. These unexpected compounds could be the result of a cross contamination event or may actually be present in the sample. Therefore, spike-in cross contamination and sample swapping controls are also needed for analytical chemistry analyses.

In one embodiment, control compositions for sequencing or chemical analyses are provided. The control compositions comprise a nucleic acid construct comprising at least one barcode sequence fragment. The barcode sequence fragment comprises a unique sequence not found in any known genome. In one embodiment, the control composition is used to determine if cross-contamination between samples for sequencing or chemical analyses has occurred. In another embodiment, the control composition is used to determine if sample swapping has occurred. In yet another embodiment, the control composition can be used for quantitation of nucleic acids during sequencing. In one aspect, the nucleic acid construct is a deoxyribonucleic acid construct. In another aspect, the nucleic acid construct is a ribonucleic acid. In another embodiment, the nucleic acid construct is incorporated into a plasmid.

In various embodiments, the barcode sequence fragment can be from about 10 to about 35 base pairs in length, about 10 to about 34 base pairs in length, about 10 to about 33 base pairs in length, about 10 to about 32 base pairs in length, about 10 to about 31 base pairs in length, about 10 to about 30 base pairs in length, about 10 to about 29 base pairs in length, about 10 to about 28 base pairs in length, about 10 to about 27 base pairs in length, about 10 to about 26 base pairs in length, about 10 to about 25 base pairs in length, about 10 to about 24 base pairs in length, about 10 to about 15 base pairs in length, about 21 to about 28 base pairs in length, about 21 to about 27 base pairs in length, about 21 to about 26 base pairs in length, about 21 to about 25 base pairs in length, about 22 to about 28 base pairs in length, about 22 to about 27 base pairs in length, about 22 to about 26 base pairs in length, about 22 to about 25 base pairs in length, about 23 to 25 base pairs in length, or about 24 base pairs in length.

Various embodiments of barcode sequence fragments are shown below in Table 1 (labeled barcode sequence fragments). These barcode sequence fragments can be used alone or in combinations of, for example, two or more barcode sequence fragments. Additional barcode sequence fragments are shown in Table 2 between the bolded fragments and within the exemplary nucleic acid constructs having SEQ ID NOS:1 to 384.

TABLE 1

(SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGGTCAACGATA (SEQ ID NO: 775) | CATCGCGTTGAC (SEQ ID NO: 776) | ACGTAACCACGT (SEQ ID NO: 777) | CTTCTTCGCCCT (SEQ ID NO: 778) | GACGGCTATGTT (SEQ ID NO: 779) | GTCATTGGGCTA (SEQ ID NO: 780) |
| ATCGCACAGTAA (SEQ ID NO: 781) | GCACATAGTCGT (SEQ ID NO: 782) | GTCGGAAATTGT (SEQ ID NO: 783) | CAGGCATAACAT (SEQ ID NO: 784) | TCTCTTTCGACA (SEQ ID NO: 785) | AGAGACGCGTAG (SEQ ID NO: 786) |
| GTCGTGTAGCCT (SEQ ID NO: 787) | GGCAAATACACT (SEQ ID NO: 788) | TCTAACGAGTGC (SEQ ID NO: 789) | ATGTGGCGTGTT (SEQ ID NO: 790) | GATTAGGTTCCG (SEQ ID NO: 791) | TTAATGGATCGG (SEQ ID NO: 792) |
| AGCGGAGGTTAG (SEQ ID NO: 793) | GTCATGCTCCAG (SEQ ID NO: 794) | CATCTGGGCAAT (SEQ ID NO: 795) | GTGCGGTTCACT (SEQ ID NO: 796) | CTACTCCACGAG (SEQ ID NO: 797) | ATATTGGCAGCC (SEQ ID NO: 798) |
| ATCCTTTGGTTC (SEQ ID NO: 799) | CCTAGTAAGCTG (SEQ ID NO: 800) | TGTCCGTGGATC (SEQ ID NO: 801) | CCTCACTAGCGA (SEQ ID NO: 802) | GGTGCAGACAGA (SEQ ID NO: 803) | TCGCATGGATAC (SEQ ID NO: 804) |
| TACAGCGCATAC (SEQ ID NO: 805) | TTACCGACGAGT (SEQ ID NO: 806) | ACTCGGCCAACT (SEQ ID NO: 807) | AGCTGATAGTTG (SEQ ID NO: 808) | CCGTACCGTATG (SEQ ID NO: 809) | CAACAATGCCAA (SEQ ID NO: 810) |
| ACCGGTATGTAC (SEQ ID NO: 811) | GCTTAGATGTAG (SEQ ID NO: 812) | GTTGGTTGGCAT (SEQ ID NO: 813) | GCTCTAGTAACG (SEQ ID NO: 814) | ATGTCCGACCAA (SEQ ID NO: 815) | GCCCGACATATA (SEQ ID NO: 816) |
| AATTGTGTCGGA (SEQ ID NO: 817) | AAGACGTAGCGG (SEQ ID NO: 818) | TTCCACACGTGG (SEQ ID NO: 819) | TGGTCCTACAAG (SEQ ID NO: 820) | AGATGGGACTGG (SEQ ID NO: 821) | GATTGAACGCTA (SEQ ID NO: 822) |
| TGCATACACTGG (SEQ ID NO: 823) | TTACCTTACACC (SEQ ID NO: 824) | AACCCAGATGAT (SEQ ID NO: 825) | CGCTATCCAGAC (SEQ ID NO: 826) | GTGCCCACTTGA (SEQ ID NO: 827) | AGTATTCGCGCA (SEQ ID NO: 828) |
| AGTCGAACGAGG (SEQ ID NO: 829) | TGACTAATGGCC (SEQ ID NO: 830) | GTAGTGTCAACA (SEQ ID NO: 831) | GCTTACGTAGGT (SEQ ID NO: 832) | ACCGAACAATCC (SEQ ID NO: 833) | TGCCAACAACAA (SEQ ID NO: 834) |
| ACCAGTGACTCA (SEQ ID NO: 835) | CTCTCTCACTTG (SEQ ID NO: 836) | TGGAGAGGAGAT (SEQ ID NO: 837) | AGTTGGTTACGA (SEQ ID NO: 838) | GTCTACCACGCA (SEQ ID NO: 839) | CTAAAGTAGCAC (SEQ ID NO: 840) |
| GAATACCAAGTC (SEQ ID NO: 841) | ATTGCAAGCAAC (SEQ ID NO: 842) | CGTATAAATGCG (SEQ ID NO: 843) | CTCTACGAACAG (SEQ ID NO: 844) | TCGCGTCCAGTA (SEQ ID NO: 845) | AGTGCTAGGTTA (SEQ ID NO: 846) |
| GTAGATCGTGTA (SEQ ID NO: 847) | CACGTGACATGT (SEQ ID NO: 848) | AATACAGACCTG (SEQ ID NO: 849) | CCTGTGTTGGTG (SEQ ID NO: 850) | GCCTGATTAAGC (SEQ ID NO: 851) | CGGAAACTCCAT (SEQ ID NO: 852) |
| TAACGTGTGTGC (SEQ ID NO: 853) | CACAGTTGAAGT (SEQ ID NO: 854) | GACTCAACCAGT (SEQ ID NO: 855) | GATGGGAGGACT (SEQ ID NO: 856) | ACGTATTCGAAG (SEQ ID NO: 857) | AGGAAAGCCAGA (SEQ ID NO: 858) |
| CATTATGGCGTG (SEQ ID NO: 859) | CTAGGATCACTG (SEQ ID NO: 860) | GGAAGAAGTAGC (SEQ ID NO: 861) | CAGAATCGCTCA (SEQ ID NO: 862) | CGGCTACTATGC (SEQ ID NO: 863) | GTCTGACGGTCT (SEQ ID NO: 864) |
| CCAATACGCCTG (SEQ ID NO: 865) | GATGACCCAAAT (SEQ ID NO: 866) | ATCGATCCACAG (SEQ ID NO: 867) | TGGCACTGGTTA (SEQ ID NO: 868) | AGTTCGGCATTG (SEQ ID NO: 869) | GAAACCAAGCTT (SEQ ID NO: 870) |
| GATCTGCGATCC (SEQ ID NO: 871) | ACCGGAGTAGGA (SEQ ID NO: 872) | ACACCGCACAAT (SEQ ID NO: 873) | GGCAGTGTTAAT (SEQ ID NO: 874) | TTGGGAGCGAAG (SEQ ID NO: 875) | TCATCACGGGCT (SEQ ID NO: 876) |
| CAGCTCATCAGC (SEQ ID NO: 877) | TGAGGACTACCT (SEQ ID NO: 878) | GTCTCCTCCCTT (SEQ ID NO: 879) | AACCCGTCGTCA (SEQ ID NO: 880) | TGTTCGCCCAGA (SEQ ID NO: 881) | TGTTCTGAGACG (SEQ ID NO: 882) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
| --- | --- | --- | --- | --- | --- |
| CAAACAACAGCT (SEQ ID NO: 883) | CAATCGGCTTGC (SEQ ID NO: 884) | GTAGCACTCATG (SEQ ID NO: 885) | AGAGGAGTCGAC (SEQ ID NO: 886) | CGCGTATCTCAG (SEQ ID NO: 887) | ATAGCACCAGAT (SEQ ID NO: 888) |
| GCAACACCATCC (SEQ ID NO: 889) | AACACTCGATCG (SEQ ID NO: 890) | CACCTGTAGTAG (SEQ ID NO: 891) | TAAGTCGGCCTA (SEQ ID NO: 892) | CGAAAGCATTCC (SEQ ID NO: 893) | ATCTCGCTGGGT (SEQ ID NO: 894) |
| GCGATATATCGC (SEQ ID NO: 895) | TGACCGGCTGTT (SEQ ID NO: 896) | CACGAGCTACTC (SEQ ID NO: 897) | CAGGGTAGGGTA (SEQ ID NO: 898) | CCGGACAAGAAG (SEQ ID NO: 899) | GCGCGTGTATCT (SEQ ID NO: 900) |
| CGAGCAATCCTA (SEQ ID NO: 901) | GGAGGAGCAATA (SEQ ID NO: 902) | TCTCGATAAGCG (SEQ ID NO: 903) | CATGGGTGTTAC (SEQ ID NO: 904) | CGATCCGATCTG (SEQ ID NO: 905) | AACGCGAAATTC (SEQ ID NO: 906) |
| AGTCGTGCACAT (SEQ ID NO: 907) | AGCGACGAAGAC (SEQ ID NO: 908) | TAGACACCGTGT (SEQ ID NO: 909) | GATGCCTAATGA (SEQ ID NO: 910) | TGCATCGCGTCA (SEQ ID NO: 911) | ATCTGGACGATC (SEQ ID NO: 912) |
| GTATCTGCGCGT (SEQ ID NO: 913) | CTTCCCTAACTC (SEQ ID NO: 914) | AGACAAGCTTCC (SEQ ID NO: 915) | TTATCGGGCATG (SEQ ID NO: 916) | ATGGACCTAGCT (SEQ ID NO: 917) | CCAGCTGGACTT (SEQ ID NO: 918) |
| CGAGGGAAAGTC (SEQ ID NO: 919) | TGGAAGAACGGC (SEQ ID NO: 920) | TCCGCAACCTGA (SEQ ID NO: 921) | TGGACATAAACC (SEQ ID NO: 922) | AGGAATACTCAC (SEQ ID NO: 923) | CTCTAACCTCTA (SEQ ID NO: 924) |
| CAAATTCGGGAT (SEQ ID NO: 925) | GCTAGACACTAC (SEQ ID NO: 926) | TCACTTGGTGCG (SEQ ID NO: 927) | TGACCTCAAGAC (SEQ ID NO: 928) | CTACCTTGAGGA (SEQ ID NO: 929) | CAACCGAGATTA (SEQ ID NO: 930) |
| AGATTGACCAAC (SEQ ID NO: 931) | TTGGATTGAACG (SEQ ID NO: 932) | TTATGTACGGCG (SEQ ID NO: 933) | GCCAAATCGCTC (SEQ ID NO: 934) | CGTGTTATGTGG (SEQ ID NO: 935) | GATTCGAGTGTC (SEQ ID NO: 936) |
| AGTTACGAGCTA (SEQ ID NO: 937) | GATATACCAGTG (SEQ ID NO: 938) | TTGGACGTCCAC (SEQ ID NO: 939) | TCAAAGCTCAAG (SEQ ID NO: 940) | GTACGCACAGTT (SEQ ID NO: 941) | GGTAACCTCTGA (SEQ ID NO: 942) |
| GCATATGCACTG (SEQ ID NO: 943) | AACAAACTGCCA (SEQ ID NO: 944) | TCCAGGGCTATA (SEQ ID NO: 945) | TACCAATCGGTG (SEQ ID NO: 946) | TGGACTCAGCTA (SEQ ID NO: 947) | AGCGAACCTGTT (SEQ ID NO: 948) |
| CAACTCCCGTGA (SEQ ID NO: 949) | GTAGACATGTGT (SEQ ID NO: 950) | GCGTAGAGAGAC (SEQ ID NO: 951) | GTACTCGAACCA (SEQ ID NO: 952) | ACGCGCTAAATC (SEQ ID NO: 953) | ACATGCACATGC (SEQ ID NO: 954) |
| TTGCGTTAGCAG (SEQ ID NO: 955) | TACAGTTACGCG (SEQ ID NO: 956) | GAAACTCCTAGA (SEQ ID NO: 957) | TTCCGGCGATTG (SEQ ID NO: 958) | GACCTGAATACA (SEQ ID NO: 959) | CCTTACCTCCTC (SEQ ID NO: 960) |
| TACGAGCCCTAA (SEQ ID NO: 961) | CAAGCCCTAGTA (SEQ ID NO: 962) | ATCGGGCTTAAC (SEQ ID NO: 963) | GACATGCGGAGA (SEQ ID NO: 964) | ACGTTTGTGGCA (SEQ ID NO: 965) | ACACTGGTCCTG (SEQ ID NO: 966) |
| CACTACGCTAGA (SEQ ID NO: 967) | TAGTGTCGGATC (SEQ ID NO: 968) | TACGCCCATCAG (SEQ ID NO: 969) | CGCACCCATACA (SEQ ID NO: 970) | GCTTAACGTGCC (SEQ ID NO: 971) | AGCTTGAATCAG (SEQ ID NO: 972) |
| TGCAGTCCTCGA (SEQ ID NO: 973) | CTGAGCTCTGCA (SEQ ID NO: 974) | AAGATCGTACTG (SEQ ID NO: 975) | ACATTGAAGCGT (SEQ ID NO: 976) | GAATGGATGGGC (SEQ ID NO: 977) | TAAAGCGAGGAG (SEQ ID NO: 978) |
| ACCATAGCTCCG (SEQ ID NO: 979) | CTTCGACTTTCC (SEQ ID NO: 980) | ACTCATCTTCCA (SEQ ID NO: 981) | GACGACATTTAG (SEQ ID NO: 982) | CATGAACAGTGT (SEQ ID NO: 983) | CGACAACTTGTG (SEQ ID NO: 984) |
| TCGACATCTCTT (SEQ ID NO: 985) | GTCATAAGAACC (SEQ ID NO: 986) | GAGATACAGTTC (SEQ ID NO: 987) | CCAACTACTCGG (SEQ ID NO: 988) | GACTAGTCAGCT (SEQ ID NO: 989) | CGCTGGCTTTAG (SEQ ID NO: 990) |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GAACACTTTGGA (SEQ ID NO: 991) | GTCCGCAAGTTA (SEQ ID NO: 992) | GCATGCATCCCA (SEQ ID NO: 993) | CCGTTATCAGCG (SEQ ID NO: 994) | CAAGAAATTCGC (SEQ ID NO: 995) | GTGATACCCGCT (SEQ ID NO: 996) |
| GAGCCATCTGTA (SEQ ID NO: 997) | CGTAGAGCTCTC (SEQ ID NO: 998) | GATCTAATCGAG (SEQ ID NO: 999) | TATGGCCAAACC (SEQ ID NO: 1000) | AAGCTCTCCCAG (SEQ ID NO: 1001) | CCAGTTCCAAAG (SEQ ID NO: 1002) |
| TTGGGTACACGT (SEQ ID NO: 1003) | CCTCTGAGAGCT (SEQ ID NO: 1004) | AATCTTGCGCCG (SEQ ID NO: 1005) | TGCCTAAGATCG (SEQ ID NO: 1006) | TGGATCTGTCCG (SEQ ID NO: 1007) | GTCTGGATTGAA (SEQ ID NO: 1008) |
| AAGGCGCTCCTT (SEQ ID NO: 1009) | CCTCGATGCAGT (SEQ ID NO: 1010) | GGAAATCCCATC (SEQ ID NO: 1011) | TTAACTGGAAGC (SEQ ID NO: 1012) | CCTACTCGGTGA (SEQ ID NO: 1013) | GCGCAATAGTAT (SEQ ID NO: 1014) |
| TAATACGGATCG (SEQ ID NO: 1015) | GCGGACTATTCA (SEQ ID NO: 1016) | GACCGTCAATAC (SEQ ID NO: 1017) | ATTCGAGCTGTG (SEQ ID NO: 1018) | ATACCGTCTTTC (SEQ ID NO: 1019) | AGCGTTGTCCAA (SEQ ID NO: 1020) |
| TCGGAATTAGAC (SEQ ID NO: 1021) | CGTGCACAATTG (SEQ ID NO: 1022) | TTGGAACGGCTT (SEQ ID NO: 1023) | GGTCTGTTGAGT (SEQ ID NO: 1024) | AAGGACCGTTTC (SEQ ID NO: 1025) | CGCCTAAACCGT (SEQ ID NO: 1026) |
| TGTGAATTCGGA (SEQ ID NO: 1027) | CGGCCTAAGTTC (SEQ ID NO: 1028) | TCCTAGGTCCGA (SEQ ID NO: 1029) | CTCGTCGACTGA (SEQ ID NO: 1030) | AAGTAGGAAGGA (SEQ ID NO: 1031) | AACACCATCGAC (SEQ ID NO: 1032) |
| CATTCGTGGCGT (SEQ ID NO: 1033) | AGCGCTCACATC (SEQ ID NO: 1034) | TCCTCACTATCA (SEQ ID NO: 1035) | TCTTTCATACCG (SEQ ID NO: 1036) | CGTGCCGCTTAA (SEQ ID NO: 1037) | CTATAGACACGA (SEQ ID NO: 1038) |
| TACTACGTGGCC (SEQ ID NO: 1039) | TGGTTATGGCAC (SEQ ID NO: 1040) | GCCTGCAGTACT (SEQ ID NO: 1041) | CATTCCCGAAAG (SEQ ID NO: 1042) | GCGTCATGCATC (SEQ ID NO: 1043) | CAAGAGCGGATG (SEQ ID NO: 1044) |
| GGCCAGTTCCTA (SEQ ID NO: 1045) | CGAGGTTCTGAT (SEQ ID NO: 1046) | GCCCAAGTTCAC (SEQ ID NO: 1047) | TTGTCAGCTGGA (SEQ ID NO: 1048) | CGTTGGACAAAT (SEQ ID NO: 1049) | CCTTTGGCTGAG (SEQ ID NO: 1050) |
| GATGTTCGCTAG (SEQ ID NO: 1051) | AACTCCTGTGGA (SEQ ID NO: 1052) | ATAAAGAGGAGG (SEQ ID NO: 1053) | ATCTGCGCACCA (SEQ ID NO: 1054) | TTGTTGATGGAG (SEQ ID NO: 1055) | CGACCCATACGT (SEQ ID NO: 1056) |
| CTATCTCCTGTC (SEQ ID NO: 1057) | TAATGGTCGTAG (SEQ ID NO: 1058) | GCGCCGAATCTT (SEQ ID NO: 1059) | CCACGTACGTAA (SEQ ID NO: 1060) | CTTACACTGCTT (SEQ ID NO: 1061) | CTGGATTACGGT (SEQ ID NO: 1062) |
| ACTCACAGGAAT (SEQ ID NO: 1063) | TTGCACCGTCGA (SEQ ID NO: 1064) | ATCCCAGCATGC (SEQ ID NO: 1065) | ACGATATGGTCA (SEQ ID NO: 1066) | AATGCGCGTATA (SEQ ID NO: 1067) | ACCACACGTAGT (SEQ ID NO: 1068) |
| ATGATGAGCCTC (SEQ ID NO: 1069) | TGCTACAGACGT (SEQ ID NO: 1070) | GCTTCCAGACAA (SEQ ID NO: 1071) | GAGACAGTGGAA (SEQ ID NO: 1072) | TGCCATTAGAGC (SEQ ID NO: 1073) | CTAGTGACCTAG (SEQ ID NO: 1074) |
| GTCGACAGAGGA (SEQ ID NO: 1075) | ATGGCCTGACTA (SEQ ID NO: 1076) | ACACAGTCCTGA (SEQ ID NO: 1077) | TCGTAGTAATGG (SEQ ID NO: 1078) | CGAAGGGTTGGA (SEQ ID NO: 1079) | GGATTCGTGTCC (SEQ ID NO: 1080) |
| TGTCGCAAATAG (SEQ ID NO: 1081) | ACGCACATACAA (SEQ ID NO: 1082) | ATTATACGGCGC (SEQ ID NO: 1083) | AGGCTGTACTCC (SEQ ID NO: 1084) | GAGCAACATCCT (SEQ ID NO: 1085) | GTGAGATACCTA (SEQ ID NO: 1086) |
| CATCCCTCTACT (SEQ ID NO: 1087) | TGAGTGGTCTGT (SEQ ID NO: 1088) | ATTCAGATGGCA (SEQ ID NO: 1089) | CGGAAGAGAACA (SEQ ID NO: 1090) | TCGTGTTGTGGC (SEQ ID NO: 1091) | CGCGGTTACTAA (SEQ ID NO: 1092) |
| TATACCGCTGCG (SEQ ID NO: 1093) | GATAGCACTCGT (SEQ ID NO: 1094) | TAAACGCGACTC (SEQ ID NO: 1095) | CTGCGGATATAC (SEQ ID NO: 1096) | ATTTCGACCCGG (SEQ ID NO: 1097) | AGGCCCGTTTAC (SEQ ID NO: 1098) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| AGTTGAGGCATT (SEQ ID NO: 1099) | TAGCGCGAACTT (SEQ ID NO: 1100) | CCTCGGGTACTA (SEQ ID NO: 1101) | CTAGCGTGCGTT (SEQ ID NO: 1102) | TGGATTGTGAAC (SEQ ID NO: 1103) | TGTTGTTGGGAA (SEQ ID NO: 1104) |
| ACAATAGACACC (SEQ ID NO: 1105) | CATACACGCACC (SEQ ID NO: 1106) | TTCACCTGTATC (SEQ ID NO: 1107) | ACCATGTAGAAC (SEQ ID NO: 1108) | CCGTTGGACTAC (SEQ ID NO: 1109) | CTGAATCTGGTG (SEQ ID NO: 1110) |
| CGGTCAATTGAC (SEQ ID NO: 1111) | ACCTCAGTCAAG (SEQ ID NO: 1112) | CTCCAGGTCATG (SEQ ID NO: 1113) | TAGCTCACAGCA (SEQ ID NO: 1114) | TCTGGCTACGAC (SEQ ID NO: 1115) | GGCCTCACTGAT (SEQ ID NO: 1116) |
| GTGGAGTCTCAT (SEQ ID NO: 1117) | TCGACCAAACAC (SEQ ID NO: 1118) | CAGGATTCGTAC (SEQ ID NO: 1119) | GTCTTGGGTCGT (SEQ ID NO: 1120) | TCAGGCGTAAAT (SEQ ID NO: 1121) | GTGGTTCGATGT (SEQ ID NO: 1122) |
| GCTCGAAGATTC (SEQ ID NO: 1123) | CCACCCAGTAAC (SEQ ID NO: 1124) | CGCATACGACCT (SEQ ID NO: 1125) | CTGTATGGAGCT (SEQ ID NO: 1126) | TCACGGTGACAT (SEQ ID NO: 1127) | TCGAGAGTTTGC (SEQ ID NO: 1128) |
| AGGCTTACGTGT (SEQ ID NO: 1129) | ATATCGCGATGA (SEQ ID NO: 1130) | GCCTCGTACTGA (SEQ ID NO: 1131) | ATGCAACTCGAA (SEQ ID NO: 1132) | CAAGGTCACCTC (SEQ ID NO: 1133) | TACGACTCTGGC (SEQ ID NO: 1134) |
| TCTCTACCACTC (SEQ ID NO: 1135) | CGCCGGTAATCT (SEQ ID NO: 1136) | ACCAACAGATTG (SEQ ID NO: 1137) | CTAACTGACGCA (SEQ ID NO: 1138) | CTATACGCGAAC (SEQ ID NO: 1139) | GCGTAACTCTCG (SEQ ID NO: 1140) |
| ACTTCCAACTTC (SEQ ID NO: 1141) | CCGATGCCTTGA (SEQ ID NO: 1142) | GTGGCCTACTAC (SEQ ID NO: 1143) | AACGTCCTGTGC (SEQ ID NO: 1144) | GAGGAGTAAAGC (SEQ ID NO: 1145) | CTTTCCCTTCGA (SEQ ID NO: 1146) |
| CTCACCTAGGAA (SEQ ID NO: 1147) | AGCAGGCACGAA (SEQ ID NO: 1148) | TTCCCTTCTCCG (SEQ ID NO: 1149) | AGACGACGTGGA (SEQ ID NO: 1150) | GCAGCATGTTAA (SEQ ID NO: 1151) | AAGATTTGCAGC (SEQ ID NO: 1152) |
| GTGTTGTCGTGC (SEQ ID NO: 1153) | TACGCAGCACTA (SEQ ID NO: 1154) | CATTTGACGACG (SEQ ID NO: 1155) | AAGGTTCCGATA (SEQ ID NO: 1156) | GTTGGGATCCTC (SEQ ID NO: 1157) | AACGGCTGGAAG (SEQ ID NO: 1158) |
| CCACAGATCGAT (SEQ ID NO: 1159) | CGCTTAGTGCTG (SEQ ID NO: 1160) | AAGTGAAGCGAG (SEQ ID NO: 1161) | AGTTTCTGGTGG (SEQ ID NO: 1162) | TTCAGCGATGGT (SEQ ID NO: 1163) | ATCGTCCGCGAT (SEQ ID NO: 1164) |
| TATCGACACAAG (SEQ ID NO: 1165) | CAAAGTTTGCGA (SEQ ID NO: 1166) | TGCCGCCGTAAT (SEQ ID NO: 1167) | TTCCTCCTGCTA (SEQ ID NO: 1168) | ACAATCCCGAGT (SEQ ID NO: 1169) | TCACAGACAATG (SEQ ID NO: 1170) |
| GATTCCGGCTCA (SEQ ID NO: 1171) | TCGAGCCGATCT (SEQ ID NO: 1172) | AACCTCGGATAA (SEQ ID NO: 1173) | CATCTCAGTCGG (SEQ ID NO: 1174) | GTTCTTGGAGAC (SEQ ID NO: 1175) | GAGACTATATGC (SEQ ID NO: 1176) |
| CGTAATTGCCGC (SEQ ID NO: 1177) | CTCATCATGTTC (SEQ ID NO: 1178) | GTGCTTGTGTAG (SEQ ID NO: 1179) | ATATGCGAGACT (SEQ ID NO: 1180) | TAGCCCTGATGC (SEQ ID NO: 1181) | AGAGGGTGATCG (SEQ ID NO: 1182) |
| GGTGACTAGTTC (SEQ ID NO: 1183) | CCAGGGACTTCT (SEQ ID NO: 1184) | CAACTAGACTCG (SEQ ID NO: 1185) | GACCACTGCTGT (SEQ ID NO: 1186) | TTGTCCCAAGCG (SEQ ID NO: 1187) | TAGAGAATGCTC (SEQ ID NO: 1188) |
| ATGGGTTCCGTC (SEQ ID NO: 1189) | GCAATCCTTGCG (SEQ ID NO: 1190) | AGTGCCCTTGGT (SEQ ID NO: 1191) | ATAGACACTCCG (SEQ ID NO: 1192) | TTCGTACTTCGT (SEQ ID NO: 1193) | AGAGCATCCACT (SEQ ID NO: 1194) |
| TAGGCATGCTTG (SEQ ID NO: 1195) | CCTGCTTCCTTC (SEQ ID NO: 1196) | GGAACGACGTGA (SEQ ID NO: 1197) | GAATCGCCGATT (SEQ ID NO: 1198) | CTGCTCAGGCAT (SEQ ID NO: 1199) | ACAGTCTGCATG (SEQ ID NO: 1200) |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| AACTAGTTCAGG (SEQ ID NO: 1201) | CAAGGCACAAGG (SEQ ID NO: 1202) | TGTCAGCTGTCG (SEQ ID NO: 1203) | TAGAAGGCTCCT (SEQ ID NO: 1204) | GACATCTGACAC (SEQ ID NO: 1205) | AATCGGTCCGAT (SEQ ID NO: 1206) |
| ATTCTGCCGAAG (SEQ ID NO: 1207) | GGCCTATAAGTC (SEQ ID NO: 1208) | CTGGTGCTGAAT (SEQ ID NO: 1209) | CGACTAACTAGA (SEQ ID NO: 1210) | CACAACCACAAC (SEQ ID NO: 1211) | CCGTTCAATGGA (SEQ ID NO: 1212) |
| AGCATGTCCCGT (SEQ ID NO: 1213) | TCCATTTCATGC (SEQ ID NO: 1214) | GACAGAGGTGCA (SEQ ID NO: 1215) | TACAACCGAGTA (SEQ ID NO: 1216) | GCACCAATCTGC (SEQ ID NO: 1217) | CTCTCGGCGTAA (SEQ ID NO: 1218) |
| GTACGATATGAC (SEQ ID NO: 1219) | TCGGCGATCATC (SEQ ID NO: 1220) | TCAGACCAACTG (SEQ ID NO: 1221) | CTCATGGTAGCA (SEQ ID NO: 1222) | ATTAGCAGCGTA (SEQ ID NO: 1223) | TCCCTCTGAGAG (SEQ ID NO: 1224) |
| GTGGTGGTTTCC (SEQ ID NO: 1225) | GTTTCACGCGAA (SEQ ID NO: 1226) | AGTGATGTGACT (SEQ ID NO: 1227) | AACGACACGCTT (SEQ ID NO: 1228) | TCCGATAATCGG (SEQ ID NO: 1229) | AAGTTAGTCCGC (SEQ ID NO: 1230) |
| TAGTATGCGCAA (SEQ ID NO: 1231) | ACAAGAACCTTG (SEQ ID NO: 1232) | CTTAGCTACTCT (SEQ ID NO: 1233) | CCTGGCTGAATA (SEQ ID NO: 1234) | CTTTCAGGACCG (SEQ ID NO: 1235) | TCAGATACCAGC (SEQ ID NO: 1236) |
| TGCGCTGAATGT (SEQ ID NO: 1237) | TACTCTCTTAGC (SEQ ID NO: 1238) | TCGGTCCATAGC (SEQ ID NO: 1239) | TTCGGATGTGAA (SEQ ID NO: 1240) | CGTCCTACAGTG (SEQ ID NO: 1241) | TCGAAGACGTAT (SEQ ID NO: 1242) |
| ATGGCTGTCAGT (SEQ ID NO: 1243) | AACTGTTCGCGC (SEQ ID NO: 1244) | CACGTTTATTCC (SEQ ID NO: 1245) | CTAGGTCCGACT (SEQ ID NO: 1246) | GTAACTCAACAG (SEQ ID NO: 1247) | CACTTCTTTGTG (SEQ ID NO: 1248) |
| GTTCTCTTCTCG (SEQ ID NO: 1249) | CGAAGCATCTAC (SEQ ID NO: 1250) | GAAACGGAAACG (SEQ ID NO: 1251) | AGATCCCGTACC (SEQ ID NO: 1252) | CGTGGAAGACGA (SEQ ID NO: 1253) | CGTCGATTGCAC (SEQ ID NO: 1254) |
| CGTAAGATGCCT (SEQ ID NO: 1255) | GTTTGGCCACAC (SEQ ID NO: 1256) | GGTCGTGTCTTG (SEQ ID NO: 1257) | TCTGGTGCATCG (SEQ ID NO: 1258) | GAGAGGGATCAC (SEQ ID NO: 1259) | GTTGCCTCTGAG (SEQ ID NO: 1260) |
| GCGTTCTAGCTG (SEQ ID NO: 1261) | TCAGGTTGCCCA (SEQ ID NO: 1262) | CGTCGTCTAAGA (SEQ ID NO: 1263) | CAGCTGGTTCAA (SEQ ID NO: 1264) | TCGGCTTGGAAT (SEQ ID NO: 1265) | CACCTCCAAGGT (SEQ ID NO: 1266) |
| GTTGTTCTGGGA (SEQ ID NO: 1267) | TCATTCCACTCA (SEQ ID NO: 1268) | CAAGCGTTGTCC (SEQ ID NO: 1269) | GCTGGATTGTCA (SEQ ID NO: 1270) | TGAACAGGTTCA (SEQ ID NO: 1271) | GTAAGCCTCGAT (SEQ ID NO: 1272) |
| GGACTTCCAGCT (SEQ ID NO: 1273) | GTCACATCACGA (SEQ ID NO: 1274) | GACTTATGCCCG (SEQ ID NO: 1275) | TCTTGTTTCTGG (SEQ ID NO: 1276) | GAGAGATCGACG (SEQ ID NO: 1277) | CTCCGCTATAGG (SEQ ID NO: 1278) |
| CTCACAACCGTG (SEQ ID NO: 1279) | CGACATTTCTCT (SEQ ID NO: 1280) | GTGACGTTAGTC (SEQ ID NO: 1281) | TTGAACAAGCCA (SEQ ID NO: 1282) | ATACAAACGCAC (SEQ ID NO: 1283) | ACTGCTATCGCG (SEQ ID NO: 1284) |
| CTGCTATTCCTC (SEQ ID NO: 1285) | GGACGTTAACTA (SEQ ID NO: 1286) | GAGTCTTGGTAA (SEQ ID NO: 1287) | CCAGGTTAATGC (SEQ ID NO: 1288) | GATTCACTGTGG (SEQ ID NO: 1289) | ACCACTTGCCAG (SEQ ID NO: 1290) |
| ATGTCACCGCTG (SEQ ID NO: 1291) | TAGCAGTTGCGT (SEQ ID NO: 1292) | TCGTCGCCAAAC (SEQ ID NO: 1293) | ATTCGTACCTCT (SEQ ID NO: 1294) | GCTTGCCAATCG (SEQ ID NO: 1295) | ACCAGAAATGTC (SEQ ID NO: 1296) |
| TGTAACGCCGAT (SEQ ID NO: 1297) | CACGCTATTGGA (SEQ ID NO: 1298) | AACATGCATGCC (SEQ ID NO: 1299) | TAGCGTTCCAGA (SEQ ID NO: 1300) | CTGACACGAATA (SEQ ID NO: 1301) | ATGCTTGCTCTT (SEQ ID NO: 1302) |
| AGCAGAACATCT (SEQ ID NO: 1303) | AACTTCACTTCC (SEQ ID NO: 1304) | GTCTGTTGAGTG (SEQ ID NO: 1305) | CCAGAAGTGTTC (SEQ ID NO: 1306) | GTTCTAAGGTGA (SEQ ID NO: 1307) | ACAGTTGTACGC (SEQ ID NO: 1308) |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGGAGTAGGTGG (SEQ ID NO: 1309) | CCAGTGGATATA (SEQ ID NO: 1310) | TGAGTTCGGTCC (SEQ ID NO: 1311) | ACGATCATCTGG (SEQ ID NO: 1312) | CGTGAATCAACC (SEQ ID NO: 1313) | AGCTACTGCGTC (SEQ ID NO: 1314) |
| TTGGCTCTATTC (SEQ ID NO: 1315) | TGTGTGTAACGC (SEQ ID NO: 1316) | TTACGTGGCGAT (SEQ ID NO: 1317) | ACTGTACATGAG (SEQ ID NO: 1318) | GAGCTAAGTTAC (SEQ ID NO: 1319) | ACTGCCCGATAC (SEQ ID NO: 1320) |
| GATCCCACGTAC (SEQ ID NO: 1321) | CCAATCGTGCAA (SEQ ID NO: 1322) | CAATGCCTCACG (SEQ ID NO: 1323) | TGCCCGGACTTA (SEQ ID NO: 1324) | AGCGATTCCTCG (SEQ ID NO: 1325) | CACAGCGTCCTA (SEQ ID NO: 1326) |
| TACCGCTTCTTC (SEQ ID NO: 1327) | AGGCTAGCAGAG (SEQ ID NO: 1328) | TGTACGGATAAC (SEQ ID NO: 1329) | ATCCCGTACGTG (SEQ ID NO: 1330) | CCAACCCAGATC (SEQ ID NO: 1331) | ACGTCCACTGTG (SEQ ID NO: 1332) |
| TGTGCGATAACA (SEQ ID NO: 1333) | GTCACTCCGAAC (SEQ ID NO: 1334) | AATCAACTAGGC (SEQ ID NO: 1335) | CTTGTTGTTCTG (SEQ ID NO: 1336) | GATTGCTACCAG (SEQ ID NO: 1337) | CGCTAATCGTGA (SEQ ID NO: 1338) |
| GATTATCGACGA (SEQ ID NO: 1339) | CACCGAAATCTG (SEQ ID NO: 1340) | GTGAGGGCAAGT (SEQ ID NO: 1341) | TGACAGAATCCA (SEQ ID NO: 1342) | GGCTCTAACGTA (SEQ ID NO: 1343) | GGCCGTTCGATT (SEQ ID NO: 1344) |
| GCCTAGCCCAAT (SEQ ID NO: 1345) | TGACGTAGAACT (SEQ ID NO: 1346) | CGTGGGCTCATT (SEQ ID NO: 1347) | CACTGTATGAAG (SEQ ID NO: 1348) | AATCTGCACCGA (SEQ ID NO: 1349) | GGAACTTACTCG (SEQ ID NO: 1350) |
| GATGTATGTGGT (SEQ ID NO: 1351) | CTATGCCGGCTA (SEQ ID NO: 1352) | CGTACCAGATCC (SEQ ID NO: 1353) | TGGATGCGCATT (SEQ ID NO: 1354) | CCAGCCTTCAGA (SEQ ID NO: 1355) | CAGTTACCCAAG (SEQ ID NO: 1356) |
| ACTCCTTGTGTT (SEQ ID NO: 1357) | GTGGTATGGGAG (SEQ ID NO: 1358) | ATGTTTAGACGG (SEQ ID NO: 1359) | GCCCATATCAGA (SEQ ID NO: 1360) | CCGTGTTAGACA (SEQ ID NO: 1361) | GAGGGACGCAAT (SEQ ID NO: 1362) |
| GTCACGGACATT (SEQ ID NO: 1363) | TGTACCAACCGA (SEQ ID NO: 1364) | ACATGTCACGTG (SEQ ID NO: 1365) | CGTGTGTGCTCA (SEQ ID NO: 1366) | ACCTCTATTCGT (SEQ ID NO: 1367) | TAGGCCATGTAA (SEQ ID NO: 1368) |
| GCGAGCGAAGTA (SEQ ID NO: 1369) | AGGGTACAGGGT (SEQ ID NO: 1370) | CTTTAGCGCTGG (SEQ ID NO: 1371) | ATCCATGAGCGT (SEQ ID NO: 1372) | GGCAAGGCACAA (SEQ ID NO: 1373) | AACCGTCGCCTA (SEQ ID NO: 1374) |
| ATCTACCGAAGC (SEQ ID NO: 1375) | AGAGTGCTAATC (SEQ ID NO: 1376) | CTGGTCTTACGG (SEQ ID NO: 1377) | TAGACTTCAGAG (SEQ ID NO: 1378) | GCCATTATAGAG (SEQ ID NO: 1379) | TTACGAAGTTGG (SEQ ID NO: 1380) |
| ACTTGGTGTAAG (SEQ ID NO: 1381) | TTGGCGGGTTAT (SEQ ID NO: 1382) | CAAGTCGAATAC (SEQ ID NO: 1383) | TGATTCCCGGTG (SEQ ID NO: 1384) | TAACCGAACCAC (SEQ ID NO: 1385) | AGATAGCTCGCT (SEQ ID NO: 1386) |
| TCTTGGAGGTCA (SEQ ID NO: 1387) | CACGATGGTCAT (SEQ ID NO: 1388) | GCAAGTGTGAGG (SEQ ID NO: 1389) | AGTTCCACGGCT (SEQ ID NO: 1390) | GGTGCGTCACTT (SEQ ID NO: 1391) | CTGGTTGGCATC (SEQ ID NO: 1392) |
| TCACCTCCTTGT (SEQ ID NO: 1393) | GTCACCAATCCG (SEQ ID NO: 1394) | CTCGGTCAACCA (SEQ ID NO: 1395) | GGAAGCTTAACT (SEQ ID NO: 1396) | TGTGCTTGTAGG (SEQ ID NO: 1397) | CTGCTTCTTACA (SEQ ID NO: 1398) |
| GCACACCTGATA (SEQ ID NO: 1399) | CACTAACAAACG (SEQ ID NO: 1400) | ACCCTATTGCGG (SEQ ID NO: 1401) | GGAGACGTTCTT (SEQ ID NO: 1402) | TGACTCTGCGGT (SEQ ID NO: 1403) | GTTCGAGTGAAT (SEQ ID NO: 1404) |
| GCGACAATTACA (SEQ ID NO: 1405) | TTCCAGGCAGAT (SEQ ID NO: 1406) | TCCGTTCGTTTA (SEQ ID NO: 1407) | ATTGCGCTACCG (SEQ ID NO: 1408) | GTACACTGATAG (SEQ ID NO: 1409) | TTCTTCTACCGC (SEQ ID NO: 1410) |
| TCATGCTCCATT (SEQ ID NO: 1411) | TATGGTACCCAG (SEQ ID NO: 1412) | ACCACCGTAACC (SEQ ID NO: 1413) | CCGACCAGCTTA (SEQ ID NO: 1414) | TTACATCCCTTG (SEQ ID NO: 1415) | TCTCTCGATCAT (SEQ ID NO: 1416) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| AGCTGTCAAGCT (SEQ ID NO: 1417) | CACGACTTGACA (SEQ ID NO: 1418) | CATTTCGCACTT (SEQ ID NO: 1419) | CAATCCACCGAA (SEQ ID NO: 1420) | GGTGTGAGAAAG (SEQ ID NO: 1421) | AATCCATGACAG (SEQ ID NO: 1422) |
| GAGAGCAACAGA (SEQ ID NO: 1423) | CTTGGAGGCTTA (SEQ ID NO: 1424) | TTAAGCGCCTGA (SEQ ID NO: 1425) | TACGCGTACAGT (SEQ ID NO: 1426) | CTCTTTGTCGAT (SEQ ID NO: 1427) | GGTATTCAAAGC (SEQ ID NO: 1428) |
| TACTCGGGAACT (SEQ ID NO: 1429) | ACGTGGTTCCAC (SEQ ID NO: 1430) | TGCGGGATTCAT (SEQ ID NO: 1431) | CCGTCAAGATGT (SEQ ID NO: 1432) | GTGAACTGGATT (SEQ ID NO: 1433) | GGTCCACCTAAC (SEQ ID NO: 1434) |
| CGTGCTTAGGCT (SEQ ID NO: 1435) | GACGCTTTGCTG (SEQ ID NO: 1436) | CAAACTGCGTTG (SEQ ID NO: 1437) | TACACGCTGATG (SEQ ID NO: 1438) | CCTAACGGTCCA (SEQ ID NO: 1439) | TGATCACTCTTC (SEQ ID NO: 1440) |
| TACCGAAGGTAT (SEQ ID NO: 1441) | ACAGGGTTTGTA (SEQ ID NO: 1442) | TTAGACTCGGAA (SEQ ID NO: 1443) | CGTTTCAAGGAC (SEQ ID NO: 1444) | TGTAGCCGCTTG (SEQ ID NO: 1445) | GGCACGAAAGGT (SEQ ID NO: 1446) |
| CACTCATCATTC (SEQ ID NO: 1447) | GCCTATGAGATC (SEQ ID NO: 1448) | GACCGATAGGGA (SEQ ID NO: 1449) | GCAGAACTTAGT (SEQ ID NO: 1450) | TACCCGACTAAG (SEQ ID NO: 1451) | CATGAGACTGTA (SEQ ID NO: 1452) |
| GTATTTCGGACG (SEQ ID NO: 1453) | CAAACCTATGGC (SEQ ID NO: 1454) | GGCGAACTGAAG (SEQ ID NO: 1455) | ACCCGTTGATGA (SEQ ID NO: 1456) | CGTAGTACCACA (SEQ ID NO: 1457) | GGTCATCACGAT (SEQ ID NO: 1458) |
| TATCTATCCTGC (SEQ ID NO: 1459) | ATCGCTTAAGGC (SEQ ID NO: 1460) | CGGCACTATCAC (SEQ ID NO: 1461) | GACGTAGAACGG (SEQ ID NO: 1462) | CGGAGAGACATG (SEQ ID NO: 1463) | AGTCTAGAGTAC (SEQ ID NO: 1464) |
| TTGCCAAGAGTC (SEQ ID NO: 1465) | ACCATCCAACGA (SEQ ID NO: 1466) | AGGTGGTGGAGT (SEQ ID NO: 1467) | CGGTACCTACCA (SEQ ID NO: 1468) | CCAAAGCCAGTT (SEQ ID NO: 1469) | TGCGCAAAGGAG (SEQ ID NO: 1470) |
| AGTAGCGGAAGA (SEQ ID NO: 1471) | GCAATAGGAGGA (SEQ ID NO: 1472) | ATTCCCAGAACG (SEQ ID NO: 1473) | GCGTTTGCTAGC (SEQ ID NO: 1474) | TACGATGAGTTG (SEQ ID NO: 1475) | GGTTTGCACATG (SEQ ID NO: 1476) |
| GCAATTAGGTAC (SEQ ID NO: 1477) | CCGAACGTCACT (SEQ ID NO: 1478) | AGACGTTGCTAC (SEQ ID NO: 1479) | AGAAACAGCTCT (SEQ ID NO: 1480) | GCTTGGTAGGTT (SEQ ID NO: 1481) | TGGGTTAACACA (SEQ ID NO: 1482) |
| CATACCGTGAGT (SEQ ID NO: 1483) | ACACCAACACCA (SEQ ID NO: 1484) | AGAATAGCGCTT (SEQ ID NO: 1485) | CTCAGACTCAGA (SEQ ID NO: 1486) | CCGGAATCCATA (SEQ ID NO: 1487) | TAGGTTGCTTGG (SEQ ID NO: 1488) |
| ATGTGTGTAGAC (SEQ ID NO: 1489) | CCATCACATAGG (SEQ ID NO: 1490) | AAGCGTACATTG (SEQ ID NO: 1491) | CCGAGTACAATC (SEQ ID NO: 1492) | ATCGGCTTCCGA (SEQ ID NO: 1493) | CAGGAACCAGGA (SEQ ID NO: 1494) |
| CCTGCGAAGTAT (SEQ ID NO: 1495) | CGACACGGAGAA (SEQ ID NO: 1496) | GTTATGACGGAT (SEQ ID NO: 1497) | GATATGAACTGC (SEQ ID NO: 1498) | CACTAGACCCAC (SEQ ID NO: 1499) | TGCTCGATGTGC (SEQ ID NO: 1500) |
| TTCTCTCGACAT (SEQ ID NO: 1501) | GAACCTATGACA (SEQ ID NO: 1502) | AGCCTCATGATG (SEQ ID NO: 1503) | GCAGTCTAAGAT (SEQ ID NO: 1504) | GGAAAGGAGAAT (SEQ ID NO: 1505) | AGGTTTGGCTTG (SEQ ID NO: 1506) |
| GCTCTCCGTAGA (SEQ ID NO: 1507) | ATGCCGGTAATA (SEQ ID NO: 1508) | GTGTATCGCCAC (SEQ ID NO: 1509) | CGGCGCATTATA (SEQ ID NO: 1510) | GAGTATCTGAGT (SEQ ID NO: 1511) | TACTCCAGGCTG (SEQ ID NO: 1512) |
| GTTAAGCTGACC (SEQ ID NO: 1513) | GAACAGCTCTAC (SEQ ID NO: 1514) | CCAAACTCGTCG (SEQ ID NO: 1515) | GGTGCTAATCAC (SEQ ID NO: 1516) | CTCGCTAGATAG (SEQ ID NO: 1517) | TTCGGCATAGTG (SEQ ID NO: 1518) |
| ATGCCATGCCGT (SEQ ID NO: 1519) | GTGAGTCATACC (SEQ ID NO: 1520) | ACGTGAGGAACG (SEQ ID NO: 1521) | CGTTTGGAATGA (SEQ ID NO: 1522) | CCAGGACAGGAA (SEQ ID NO: 1523) | GTGCCATAATCG (SEQ ID NO: 1524) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GACATTGTCACG (SEQ ID NO: 1525) | TGGCCGTTACTG (SEQ ID NO: 1526) | TGAATCGAAGCT (SEQ ID NO: 1527) | GGTTAGAGCGGA (SEQ ID NO: 1528) | AAGGGTTAGTCT (SEQ ID NO: 1529) | TGCAGATCCAAC (SEQ ID NO: 1530) |
| GCCAACAACCAT (SEQ ID NO: 1531) | TAGAGCTGCCAT (SEQ ID NO: 1532) | CTGCAGTAAGTA (SEQ ID NO: 1533) | GTAGTAGACCAT (SEQ ID NO: 1534) | GTGACTAGTGAT (SEQ ID NO: 1535) | TCACTCTTGTAC (SEQ ID NO: 1536) |
| ATCAGTACTAGG (SEQ ID NO: 1537) | ATCTAGTGGCAA (SEQ ID NO: 1538) | TATAGGCTCCGC (SEQ ID NO: 1539) | ATCAAGATACGC (SEQ ID NO: 1540) | GGCCTTCAGTCA (SEQ ID NO: 1541) | TGGTGGAGTTTC (SEQ ID NO: 1542) |
| TCCTCGAGCGAT (SEQ ID NO: 1543) | CCTTCAATGGGA (SEQ ID NO: 1544) | ATCGTGTGTTGG (SEQ ID NO: 1545) | TCTATCTGGCTT (SEQ ID NO: 1546) | ACACGTTTGGGT (SEQ ID NO: 1547) | AGAACACGGAAG (SEQ ID NO: 1548) |
| ACCCAAGCGTTA (SEQ ID NO: 1549) | TTGACGACATCG (SEQ ID NO: 1550) | CTTCCGCAGACA (SEQ ID NO: 1551) | GGAAACAAACGG (SEQ ID NO: 1552) | CGAACGTCTATG (SEQ ID NO: 1553) | TCGAAACATGCA (SEQ ID NO: 1554) |
| TGCAGCAAGATT (SEQ ID NO: 1555) | ACATACTGAGCA (SEQ ID NO: 1556) | GCACTATACGCA (SEQ ID NO: 1557) | GATTGGCATAGT (SEQ ID NO: 1558) | TCATGTGAACGA (SEQ ID NO: 1559) | AACTAAGGACTC (SEQ ID NO: 1560) |
| AGCAACATTGCA (SEQ ID NO: 1561) | GGCTAAACTATG (SEQ ID NO: 1562) | TCTGGGCATTGA (SEQ ID NO: 1563) | GAGTTGTACGAT (SEQ ID NO: 1564) | TCTCCGTTCCCT (SEQ ID NO: 1565) | AACTCAATAGCG (SEQ ID NO: 1566) |
| GATGTGGTGTTA (SEQ ID NO: 1567) | AAGAGCAGAGCC (SEQ ID NO: 1568) | CCAATGATAAGC (SEQ ID NO: 1569) | CTCGAAATGCAA (SEQ ID NO: 1570) | CTGATTACGAGA (SEQ ID NO: 1571) | CTTAGAACGTGC (SEQ ID NO: 1572) |
| CAGAAATGTGTC (SEQ ID NO: 1573) | GGAGAGATCACG (SEQ ID NO: 1574) | TTAAACCGCGCC (SEQ ID NO: 1575) | AGAAGAAAGGCA (SEQ ID NO: 1576) | TCTGAATGGTAG (SEQ ID NO: 1577) | CCGTATATGCGC (SEQ ID NO: 1578) |
| GTAGAGGTAGAG (SEQ ID NO: 1579) | TCAACCCGTGAA (SEQ ID NO: 1580) | CTTGCATACCGG (SEQ ID NO: 1581) | CCACTCTCTCTA (SEQ ID NO: 1582) | CATCGTTGGTCG (SEQ ID NO: 1583) | TATGACGTACGA (SEQ ID NO: 1584) |
| CGTGATCCGCTA (SEQ ID NO: 1585) | GTTTGAAACACG (SEQ ID NO: 1586) | GTGCACGATAAT (SEQ ID NO: 1587) | CCTCCTAATTCA (SEQ ID NO: 1588) | TAGATCCTCGGA (SEQ ID NO: 1589) | TCTCTGAACAGG (SEQ ID NO: 1590) |
| GGTTATTTGGCG (SEQ ID NO: 1591) | AGAGAGACAGGT (SEQ ID NO: 1592) | GGTCTAGGTCTA (SEQ ID NO: 1593) | TTCATGGCCAGC (SEQ ID NO: 1594) | TCGGACAGTGTT (SEQ ID NO: 1595) | CCTTTATAGTCC (SEQ ID NO: 1596) |
| GGATCGTAATAC (SEQ ID NO: 1597) | TCGCCAGTGCAT (SEQ ID NO: 1598) | TCAGGACGTATC (SEQ ID NO: 1599) | ATTGGACACGCT (SEQ ID NO: 1600) | TGATGTGCTAAG (SEQ ID NO: 1601) | TGTAGGTGTGCT (SEQ ID NO: 1602) |
| GCATAGCATCAA (SEQ ID NO: 1603) | GCTCAGGACTCT (SEQ ID NO: 1604) | GAAAGGTGAGAA (SEQ ID NO: 1605) | AATTCACCTCCT (SEQ ID NO: 1606) | CAGTAAATCGCA (SEQ ID NO: 1607) | TCCCACGAAACA (SEQ ID NO: 1608) |
| GTGTTAGATGTG (SEQ ID NO: 1609) | CACTTTGGGTGC (SEQ ID NO: 1610) | GAATATACCTGG (SEQ ID NO: 1611) | ATGAAGCACTGT (SEQ ID NO: 1612) | CAAGTTTCCGCG (SEQ ID NO: 1613) | TACGCTACGACC (SEQ ID NO: 1614) |
| TTAGAGCCATGC (SEQ ID NO: 1615) | TCTAGCCTGGCA (SEQ ID NO: 1616) | GTCGCTTGCACA (SEQ ID NO: 1617) | TTGATGTGAGGT (SEQ ID NO: 1618) | ACATCGTTGACG (SEQ ID NO: 1619) | GTCAGTATGGCT (SEQ ID NO: 1620) |
| TGAACCCTATGG (SEQ ID NO: 1621) | AATGCAATGCGT (SEQ ID NO: 1622) | TCTACCACGAAG (SEQ ID NO: 1623) | TCTTGCGGAGTC (SEQ ID NO: 1624) | ACGAAAGAGCAG (SEQ ID NO: 1625) | CCATATCCCGGA (SEQ ID NO: 1626) |
| AGAGTCTTGCCA (SEQ ID NO: 1627) | CGAATGAGTCAT (SEQ ID NO: 1628) | AATATCGGGATC (SEQ ID NO: 1629) | TTAGTCGTGACG (SEQ ID NO: 1630) | TGATGAACCCGT (SEQ ID NO: 1631) | TCGTACCAGGAT (SEQ ID NO: 1632) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| ACAACACTCCGA (SEQ ID NO: 1633) | CAACGCTAGAAT (SEQ ID NO: 1634) | TAGTGCATTCGG (SEQ ID NO: 1635) | TGCCAGACCACT (SEQ ID NO: 1636) | GCTCTTATGCTT (SEQ ID NO: 1637) | AGTGACTGTCAA (SEQ ID NO: 1638) |
| CGATGCTGTTGA (SEQ ID NO: 1639) | ATCAGAGCCCAT (SEQ ID NO: 1640) | TCAATGACCGCA (SEQ ID NO: 1641) | AGGCTCCATGTA (SEQ ID NO: 1642) | CGACCTCGCATA (SEQ ID NO: 1643) | GGTGAGCAAGCA (SEQ ID NO: 1644) |
| ACGACTGCATAA (SEQ ID NO: 1645) | TCTGTAGAGCCA (SEQ ID NO: 1646) | CTATCGGAAGAT (SEQ ID NO: 1647) | ACTACTGAGGAT (SEQ ID NO: 1648) | CTAATTCTCTGC (SEQ ID NO: 1649) | AGTTCATACGGC (SEQ ID NO: 1650) |
| ACGCGAACTAAT (SEQ ID NO: 1651) | CCGACTCTAGGT (SEQ ID NO: 1652) | CGGATTGCTGTA (SEQ ID NO: 1653) | TATCTGGAAGTG (SEQ ID NO: 1654) | GGAAGTGGCCAA (SEQ ID NO: 1655) | TCGCTTTAACCT (SEQ ID NO: 1656) |
| AGCTATGTATGG (SEQ ID NO: 1657) | ATCCTACGAGCA (SEQ ID NO: 1658) | GGTACTGTACCA (SEQ ID NO: 1659) | CAGCTATGGACT (SEQ ID NO: 1660) | GATAATGTGCAC (SEQ ID NO: 1661) | GGCTTACTTGGA (SEQ ID NO: 1662) |
| ACGGGTCATCAT (SEQ ID NO: 1663) | GACAACGAATCT (SEQ ID NO: 1664) | ATCGAATCGAGT (SEQ ID NO: 1665) | TTGCTGGACGCT (SEQ ID NO: 1666) | CTCTGAGGTAAC (SEQ ID NO: 1667) | CCATCCGCAACA (SEQ ID NO: 1668) |
| GAAACATCCCAC (SEQ ID NO: 1669) | TGCGGTTGACTC (SEQ ID NO: 1670) | CTAGCAGTATGA (SEQ ID NO: 1671) | CTACTAGCGGTA (SEQ ID NO: 1672) | ATTTGCTTTGCC (SEQ ID NO: 1673) | CGCAATGAGGGA (SEQ ID NO: 1674) |
| CGTACTCTCGAG (SEQ ID NO: 1675) | TGAGAAGAAAGG (SEQ ID NO: 1676) | GTTAATGGCAGT (SEQ ID NO: 1677) | TACAGGACGGGA (SEQ ID NO: 1678) | TACTGGTAAGAC (SEQ ID NO: 1679) | GCTACAAGCCCT (SEQ ID NO: 1680) |
| TCAGTTCTCGTT (SEQ ID NO: 1681) | TCGGATCTGTGA (SEQ ID NO: 1682) | GTATGGAGCTAT (SEQ ID NO: 1683) | CTCAGGAGACTT (SEQ ID NO: 1684) | TTGAGAAGCACT (SEQ ID NO: 1685) | ATTGAAGTCTGG (SEQ ID NO: 1686) |
| TCGTGCGTGTTG (SEQ ID NO: 1687) | GCCGGTACTCTA (SEQ ID NO: 1688) | CCTTCTGTATAC (SEQ ID NO: 1689) | TCGTTGGGACTA (SEQ ID NO: 1690) | ATAACGGTGTAC (SEQ ID NO: 1691) | GGATTACGCTGT (SEQ ID NO: 1692) |
| GTTATCGCATGG (SEQ ID NO: 1693) | CACAGGATTACC (SEQ ID NO: 1694) | ACGCTGTCGGTT (SEQ ID NO: 1695) | GTCCATGGTTCG (SEQ ID NO: 1696) | TCCCGTAGCATG (SEQ ID NO: 1697) | CAGCAGTCTTCG (SEQ ID NO: 1698) |
| GATCACGAGAGG (SEQ ID NO: 1699) | CGATATCAGTAG (SEQ ID NO: 1700) | CTCGTTTCAGTT (SEQ ID NO: 1701) | TGGCATGTTGGT (SEQ ID NO: 1702) | CAGATGTCGCTA (SEQ ID NO: 1703) | CGTAGCCAACAT (SEQ ID NO: 1704) |
| GTAAATTCAGGC (SEQ ID NO: 1705) | CATAAGGGAGGC (SEQ ID NO: 1706) | GCGAACCTATAC (SEQ ID NO: 1707) | AATCGTAAGGTC (SEQ ID NO: 1708) | TGAGCAACATAC (SEQ ID NO: 1709) | ATACAGCATACG (SEQ ID NO: 1710) |
| AGTGTTTCGGAC (SEQ ID NO: 1711) | TGTGTTACTCCT (SEQ ID NO: 1712) | CTCTCATATGCT (SEQ ID NO: 1713) | CTTACGAGTAGA (SEQ ID NO: 1714) | GGTTCATGAACA (SEQ ID NO: 1715) | CTGAGTGAGTAT (SEQ ID NO: 1716) |
| ACACGCGGTTTA (SEQ ID NO: 1717) | GGTACCTGCAAT (SEQ ID NO: 1718) | CCAGTATCGCGT (SEQ ID NO: 1719) | CAACTGTCAGAC (SEQ ID NO: 1720) | GAGCGAGTTAGG (SEQ ID NO: 1721) | GCTTGTACCGAC (SEQ ID NO: 1722) |
| TGGCAAATCTAG (SEQ ID NO: 1723) | TCGCCTATAAGG (SEQ ID NO: 1724) | TCGTTTCTTCAG (SEQ ID NO: 1725) | TGACTGCGTTAG (SEQ ID NO: 1726) | GCTCAATCAGAA (SEQ ID NO: 1727) | CGCTAGGATGTT (SEQ ID NO: 1728) |
| CACCTTACCTTA (SEQ ID NO: 1729) | AGTGGCACTATC (SEQ ID NO: 1730) | AGTACCTAAGTG (SEQ ID NO: 1731) | GGCTGATGTCAT (SEQ ID NO: 1732) | GACCATGTAGTA (SEQ ID NO: 1733) | GGACAAGTGCGA (SEQ ID NO: 1734) |
| TTAACCTTCCTG (SEQ ID NO: 1735) | TAACCCGATAGA (SEQ ID NO: 1736) | GGATGCAGGATG (SEQ ID NO: 1737) | TGTCCAGTTCGG (SEQ ID NO: 1738) | CACACGCCTGAT (SEQ ID NO: 1739) | GTTCGTATACGG (SEQ ID NO: 1740) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGCCGTATGCCA (SEQ ID NO: 1741) | GTGTGCTAACGT (SEQ ID NO: 1742) | CCACTTGAGAGT (SEQ ID NO: 1743) | ACTCGTGATAGC (SEQ ID NO: 1744) | TCTTCGCAGCAG (SEQ ID NO: 1745) | CGGGTAGGGTAA (SEQ ID NO: 1746) |
| CGTGACAATAGT (SEQ ID NO: 1747) | CTTGCGGCAATC (SEQ ID NO: 1748) | GCACTTCATTTC (SEQ ID NO: 1749) | GCCCTCAAATGC (SEQ ID NO: 1750) | TCTCATGTGGAG (SEQ ID NO: 1751) | ATGCGCCCGTAT (SEQ ID NO: 1752) |
| CGCTACAACTCG (SEQ ID NO: 1753) | TGAGGTTTGATG (SEQ ID NO: 1754) | AGAATCCACCAC (SEQ ID NO: 1755) | TAAATCACGCGC (SEQ ID NO: 1756) | TTCCATCATGTC (SEQ ID NO: 1757) | CTGTCGTGTCAG (SEQ ID NO: 1758) |
| TTAAGACAGTCG (SEQ ID NO: 1759) | ATTGCTGGTCGA (SEQ ID NO: 1760) | CTCAAGTCAAAG (SEQ ID NO: 1761) | GGCGTGCATTAT (SEQ ID NO: 1762) | GTCCTACACAGC (SEQ ID NO: 1763) | ACGGTGAAAGCG (SEQ ID NO: 1764) |
| TCTGCACTGAGC (SEQ ID NO: 1765) | AAGAAGCCGGAC (SEQ ID NO: 1766) | GTACCTAGCCTG (SEQ ID NO: 1767) | GGTCAATATTGG (SEQ ID NO: 1768) | GAGGTGGGAGTT (SEQ ID NO: 1769) | TCACGTATTCTC (SEQ ID NO: 1770) |
| CGCAGATTAGTA (SEQ ID NO: 1771) | ACGGGATACAGG (SEQ ID NO: 1772) | CACTGAGTACGT (SEQ ID NO: 1773) | AGGTTCTTAGGC (SEQ ID NO: 1774) | TGGCCTAGTCAA (SEQ ID NO: 1775) | GAAGGTGAAGGT (SEQ ID NO: 1776) |
| TGGGTCCCACAT (SEQ ID NO: 1777) | AAGAGTCTCTAG (SEQ ID NO: 1778) | TCAAGCAATACG (SEQ ID NO: 1779) | TAGGTGCAATCA (SEQ ID NO: 1780) | TCCTTCCCTGCT (SEQ ID NO: 1781) | CACATGGGTTTG (SEQ ID NO: 1782) |
| CACTGGTGCATA (SEQ ID NO: 1783) | TCCGTCATGGGT (SEQ ID NO: 1784) | CATGTTGGAACA (SEQ ID NO: 1785) | GTCCAAAGCGTT (SEQ ID NO: 1786) | CTCACTGCTTCT (SEQ ID NO: 1787) | TAGGTAACCGAT (SEQ ID NO: 1788) |
| AACGTAGGCTCT (SEQ ID NO: 1789) | AGATCTATGCAG (SEQ ID NO: 1790) | ATGGGACCTTCA (SEQ ID NO: 1791) | AGATCGTGCCTA (SEQ ID NO: 1792) | TAGGAGAGACAG (SEQ ID NO: 1793) | GGTCGAATTGCT (SEQ ID NO: 1794) |
| AGTTGTAGTCCG (SEQ ID NO: 1795) | GCACAAGGCAAG (SEQ ID NO: 1796) | GCTATTCCTCAT (SEQ ID NO: 1797) | CTCCTCCCTTAC (SEQ ID NO: 1798) | TGTTCCTCTCAC (SEQ ID NO: 1799) | TGTAAACAGGTC (SEQ ID NO: 1800) |
| TCGTCAAACCCG (SEQ ID NO: 1801) | CGGCAAACACTT (SEQ ID NO: 1802) | GTCTCTGAAAGA (SEQ ID NO: 1803) | GAGCATTACATG (SEQ ID NO: 1804) | GCGTTAACCCAA (SEQ ID NO: 1805) | GTTACGTGGTTG (SEQ ID NO: 1806) |
| TAATCGGTGCCA (SEQ ID NO: 1807) | GCGAGTTCCTGT (SEQ ID NO: 1808) | GTTCTGCTTGTT (SEQ ID NO: 1809) | AAGCACGTCTCA (SEQ ID NO: 1810) | CCACACGTTTGG (SEQ ID NO: 1811) | AGGATCAGGGAA (SEQ ID NO: 1812) |
| TTGATCCGGTAG (SEQ ID NO: 1813) | TTCCGAATCGGC (SEQ ID NO: 1814) | GTCAAGACCTCA (SEQ ID NO: 1815) | TAGGGAGACCGA (SEQ ID NO: 1816) | ACAGCATAGCTC (SEQ ID NO: 1817) | TAGGACGGGAGT (SEQ ID NO: 1818) |
| CGGGTGTTTGCT (SEQ ID NO: 1819) | TACCTAGTGAGA (SEQ ID NO: 1820) | TTGTTACGTTCC (SEQ ID NO: 1821) | ATAAGCCCAATG (SEQ ID NO: 1822) | AATGTGGCTCAC (SEQ ID NO: 1823) | GCAACGAACGAG (SEQ ID NO: 1824) |
| TTGACCGCGGTT (SEQ ID NO: 1825) | CGTTCTGGTGGT (SEQ ID NO: 1826) | CAGTTCGAGATA (SEQ ID NO: 1827) | ACGTGCCTTAGA (SEQ ID NO: 1828) | GAGTTCCATTGG (SEQ ID NO: 1829) | TGACGGTTTAGC (SEQ ID NO: 1830) |
| GTGCAACCAATC (SEQ ID NO: 1831) | TTGGTCTCCTCT (SEQ ID NO: 1832) | AATGTCACCAGA (SEQ ID NO: 1833) | TCCTGCTATCTA (SEQ ID NO: 1834) | TCTGATCGAGGT (SEQ ID NO: 1835) | AAGTGTGGTTGT (SEQ ID NO: 1836) |
| GCTTGAGCTTGA (SEQ ID NO: 1837) | CTGCATACTGAG (SEQ ID NO: 1838) | CAGCCTGCAAAT (SEQ ID NO: 1839) | CACGAAAGCAGG (SEQ ID NO: 1840) | CAAGTGAAGGGA (SEQ ID NO: 1841) | CTTCGTTTCGTA (SEQ ID NO: 1842) |
| CGCTGTGGATTA (SEQ ID NO: 1843) | CAGGGCCTTTGT (SEQ ID NO: 1844) | TTGCAAGTACCG (SEQ ID NO: 1845) | TCAGTCCGCAC (SEQ ID NO: 1846) | TGCCCATCAGGT (SEQ ID NO: 1847) | CACCGCTCACAA (SEQ ID NO: 1848) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CTGTCAGTGACC (SEQ ID NO: 1849) | CGATGAATATCG (SEQ ID NO: 1850) | GCTTCTCTCACT (SEQ ID NO: 1851) | TAGCACCTAAAG (SEQ ID NO: 1852) | AGGTTGCTGTAA (SEQ ID NO: 1853) | CTGAACAGTTGC (SEQ ID NO: 1854) |
| ACGATTCGAGTC (SEQ ID NO: 1855) | GTCAATTAGTGG (SEQ ID NO: 1856) | CGAGATAGTTTG (SEQ ID NO: 1857) | GTTTCTTGTTGC (SEQ ID NO: 1858) | TAAGTACTGCAG (SEQ ID NO: 1859) | CGCTCTTAACGG (SEQ ID NO: 1860) |
| GGTTCGGTCCAT (SEQ ID NO: 1861) | AGTACGCAGTCT (SEQ ID NO: 1862) | CGCGTCAAACTA (SEQ ID NO: 1863) | ACCTAAAGCTGC (SEQ ID NO: 1864) | GCCGATTGTAAC (SEQ ID NO: 1865) | GGAGTCTCTTGC (SEQ ID NO: 1866) |
| CTGATCCATCTT (SEQ ID NO: 1867) | AGCAGCTATTGC (SEQ ID NO: 1868) | TTGACACACGAC (SEQ ID NO: 1869) | ACCACGATGCTA (SEQ ID NO: 1870) | CGGTGGAAGCAA (SEQ ID NO: 1871) | AAGTTCCGGCCT (SEQ ID NO: 1872) |
| TATGTGCCGGCT (SEQ ID NO: 1873) | CTCGGATAGATC (SEQ ID NO: 1874) | ATAAGGTCGCCT (SEQ ID NO: 1875) | GCATCTAAAGCC (SEQ ID NO: 1876) | GTTGAAGCACCT (SEQ ID NO: 1877) | GCGCTGTTTAAG (SEQ ID NO: 1878) |
| TGGTCGCATCGT (SEQ ID NO: 1879) | TTCCCGAAACGA (SEQ ID NO: 1880) | TTGCCCTTTGAT (SEQ ID NO: 1881) | CGTTGACACCCA (SEQ ID NO: 1882) | TGTCTTTACCTG (SEQ ID NO: 1883) | GACAATTCCGAA (SEQ ID NO: 1884) |
| TGTAAGACTTGG (SEQ ID NO: 1885) | GAACTTTAGCGC (SEQ ID NO: 1886) | CCTGGAATTAAG (SEQ ID NO: 1887) | CTTGGGTTAGGT (SEQ ID NO: 1888) | CCTTGTTCACCT (SEQ ID NO: 1889) | AGGTCTCCCGAT (SEQ ID NO: 1890) |
| CGGATCTAGTGT (SEQ ID NO: 1891) | TCCTTAGAAGGC (SEQ ID NO: 1892) | TGAGACCCTACA (SEQ ID NO: 1893) | CTACGTGAAATG (SEQ ID NO: 1894) | CAACCACTCGGT (SEQ ID NO: 1895) | ACGATGGTTGAT (SEQ ID NO: 1896) |
| CGATCTTCGAGC (SEQ ID NO: 1897) | GATGGACTTCAA (SEQ ID NO: 1898) | AAGTATCCTGCG (SEQ ID NO: 1899) | GCCAGCTTCATG (SEQ ID NO: 1900) | TCTTAGTCGGGC (SEQ ID NO: 1901) | AGACTTCTCAGG (SEQ ID NO: 1902) |
| GTCGAATTTGCG (SEQ ID NO: 1903) | TACTGAGCCTCG (SEQ ID NO: 1904) | CAAATGGTCGTC (SEQ ID NO: 1905) | GTGCATTCGCCA (SEQ ID NO: 1906) | GTACCGTTGCAA (SEQ ID NO: 1907) | GGATGTCTTCGC (SEQ ID NO: 1908) |
| GCATCAGAGTTA (SEQ ID NO: 1909) | AGAAGGCCTTAT (SEQ ID NO: 1910) | ACACATAAGTCG (SEQ ID NO: 1911) | TGAGAGTCCCTC (SEQ ID NO: 1912) | CTGATAGCACAC (SEQ ID NO: 1913) | TCCTGAACACAG (SEQ ID NO: 1914) |
| GTGGTCATCGTA (SEQ ID NO: 1915) | TGGAGCCTTGTC (SEQ ID NO: 1916) | TACTGCCAGTGA (SEQ ID NO: 1917) | CTCTGTAGCCGA (SEQ ID NO: 1918) | ACAGGTAGAGAG (SEQ ID NO: 1919) | AAGCCTCTACGA (SEQ ID NO: 1920) |
| CTGAAGGGCGAA (SEQ ID NO: 1921) | CTCGATGTAAGC (SEQ ID NO: 1922) | GAGTTTACGGTC (SEQ ID NO: 1923) | GCAGTAACTGTC (SEQ ID NO: 1924) | TGCTCACGTGTG (SEQ ID NO: 1925) | TACTTGCCACGG (SEQ ID NO: 1926) |
| CGCTCACAGAAT (SEQ ID NO: 1927) | AGCTTCGACAGT (SEQ ID NO: 1928) | GGCACACCCTTA (SEQ ID NO: 1929) | CATATAGCCCGA (SEQ ID NO: 1930) | GTAATAATGCCG (SEQ ID NO: 1931) | GCATAAACGACT (SEQ ID NO: 1932) |
| ATTCGGTAGTGC (SEQ ID NO: 1933) | ATACGCATCAAG (SEQ ID NO: 1934) | GTCCAGCTATGA (SEQ ID NO: 1935) | CAGTGCACGTCT (SEQ ID NO: 1936) | CTCGGCACCAAT (SEQ ID NO: 1937) | CTTTGCACTTTG (SEQ ID NO: 1938) |
| CGAGCTGTTACC (SEQ ID NO: 1939) | AGATGTCCGTCA (SEQ ID NO: 1940) | TCGCGCAACTGT (SEQ ID NO: 1941) | CAAGACTGACCT (SEQ ID NO: 1942) | ACTCGAAACCAA (SEQ ID NO: 1943) | TGACACGACATC (SEQ ID NO: 1944) |
| CAACACATGCTG (SEQ ID NO: 1945) | GCACCTGTTGAA (SEQ ID NO: 1946) | ATTCCTCTCCAC (SEQ ID NO: 1947) | CCGATAAAGGTT (SEQ ID NO: 1948) | ACCGTAAGACAT (SEQ ID NO: 1949) | TGTTGACGATGC (SEQ ID NO: 1950) |
| ATTCTCTCACGT (SEQ ID NO: 1951) | CCTAGAGAAACT (SEQ ID NO: 1952) | TGGTTCATCCTT (SEQ ID NO: 1953) | CTTTGTCAGGGC (SEQ ID NO: 1954) | ATCACGGGAGAG (SEQ ID NO: 1955) | GACAAGAAGGTG (SEQ ID NO: 1956) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CGACTCTAAACG (SEQ ID NO: 1957) | GAGGTTCTTGAC (SEQ ID NO: 1958) | AGCACTTTGAGA (SEQ ID NO: 1959) | TCCGAAGACAAT (SEQ ID NO: 1960) | TCACTGCTAGGA (SEQ ID NO: 1961) | GAGTGCTCTAAC (SEQ ID NO: 1962) |
| GTCTTCAGCAAG (SEQ ID NO: 1963) | CTGTAAAGGTTG (SEQ ID NO: 1964) | CCACGGTACTTG (SEQ ID NO: 1965) | ACTTCGGATGCA (SEQ ID NO: 1966) | CTAATCAGAGTG (SEQ ID NO: 1967) | TTGTGTCTCCCT (SEQ ID NO: 1968) |
| CGGATAACCTCC (SEQ ID NO: 1969) | TGAGTCATTGAG (SEQ ID NO: 1970) | ACTAGTTGGACC (SEQ ID NO: 1971) | TAACATCAGGCA (SEQ ID NO: 1972) | TTGGCATTGGCA (SEQ ID NO: 1973) | CGTTACCGGACT (SEQ ID NO: 1974) |
| AGGGTGACTTTA (SEQ ID NO: 1975) | TACGGCAGTTCA (SEQ ID NO: 1976) | GATCAACCCACA (SEQ ID NO: 1977) | TAATGAGATGCC (SEQ ID NO: 1978) | TATAATCCGAGG (SEQ ID NO: 1979) | TGTGCACGCCAT (SEQ ID NO: 1980) |
| GACTTCATGCGA (SEQ ID NO: 1981) | CTCTAGAAGAGT (SEQ ID NO: 1982) | ATGCGAGACTTC (SEQ ID NO: 1983) | ATCGGTGGAATT (SEQ ID NO: 1984) | TCCAGATAGCGT (SEQ ID NO: 1985) | TCCCAGAAGCTC (SEQ ID NO: 1986) |
| GCCTGTCTGCAA (SEQ ID NO: 1987) | TGCACAGTCGCT (SEQ ID NO: 1988) | CGCTTGTGTAGC (SEQ ID NO: 1989) | TATAGTGGGCCT (SEQ ID NO: 1990) | AATCCGGTCACC (SEQ ID NO: 1991) | ACGCTAGATTGA (SEQ ID NO: 1992) |
| ACTGATGGCCTC (SEQ ID NO: 1993) | CATGCGGATCCT (SEQ ID NO: 1994) | ATGAATGCGTCC (SEQ ID NO: 1995) | TCGACGGAGAGA (SEQ ID NO: 1996) | AAGTGCTTGGTA (SEQ ID NO: 1997) | TTACGGCTGGTC (SEQ ID NO: 1998) |
| TTCGATGCCGCA (SEQ ID NO: 1999) | TGCTCCGTAGAA (SEQ ID NO: 2000) | GACTCTGCTCAG (SEQ ID NO: 2001) | ATCTGACATCGG (SEQ ID NO: 2002) | GGTAAAGGGTCG (SEQ ID NO: 2003) | TGCAATGGTACC (SEQ ID NO: 2004) |
| TGTGGCTCGTGT (SEQ ID NO: 2005) | TGATAGGTACAC (SEQ ID NO: 2006) | CACGTACACGTA (SEQ ID NO: 2007) | GATAGGGCCAAG (SEQ ID NO: 2008) | GCTTTCTCAATC (SEQ ID NO: 2009) | AACAGGTCTCTG (SEQ ID NO: 2010) |
| AACTTTCAGGAG (SEQ ID NO: 2011) | CGAGTTCATCGA (SEQ ID NO: 2012) | CAGAGCTAATTG (SEQ ID NO: 2013) | CGGGCTTCATCA (SEQ ID NO: 2014) | ACAGTGCGTCCT (SEQ ID NO: 2015) | GTGCTAATAGGT (SEQ ID NO: 2016) |
| TGCACGTGATAA (SEQ ID NO: 2017) | AAGCAGATTGTC (SEQ ID NO: 2018) | TTATCCAGTCCT (SEQ ID NO: 2019) | CGTAACGTAATG (SEQ ID NO: 2020) | TAGGAACTCACC (SEQ ID NO: 2021) | GCGATCACACCT (SEQ ID NO: 2022) |
| GTTCGGTGTCCA (SEQ ID NO: 2023) | TAGAGGCGTAGG (SEQ ID NO: 2024) | CTAAGACGTCGT (SEQ ID NO: 2025) | TAGCGACCTCAC (SEQ ID NO: 2026) | TGTATTGGACAG (SEQ ID NO: 2027) | AATGGACCGTTC (SEQ ID NO: 2028) |
| AAGACAGCTATC (SEQ ID NO: 2029) | TCAGCGCCGTTA (SEQ ID NO: 2030) | GGCTCAGATTCC (SEQ ID NO: 2031) | ACCCTGGGTATC (SEQ ID NO: 2032) | AGAAAGGGTGTG (SEQ ID NO: 2033) | GTACGTCACTGA (SEQ ID NO: 2034) |
| ATTGACCGGTCA (SEQ ID NO: 2035) | TAGACCGACTCC (SEQ ID NO: 2036) | CTTGGTAGTGCC (SEQ ID NO: 2037) | AGCGAGAAGTGA (SEQ ID NO: 2038) | GCTCACAATGTG (SEQ ID NO: 2039) | TAGCCTGTCGTG (SEQ ID NO: 2040) |
| TTCTCCATCACA (SEQ ID NO: 2041) | GTCAACGCTGTC (SEQ ID NO: 2042) | GTGCTGCGCTTA (SEQ ID NO: 2043) | CTTCAAGATGGA (SEQ ID NO: 2044) | TATTGCAGCAGC (SEQ ID NO: 2045) | ACAGACGACGGA (SEQ ID NO: 2046) |
| CGTAGGTAGAGG (SEQ ID NO: 2047) | ACAGGAGGGTGT (SEQ ID NO: 2048) | AGTAGGAGGCAC (SEQ ID NO: 2049) | GCTGCGTATACC (SEQ ID NO: 2050) | AGATTCGCTCGA (SEQ ID NO: 2051) | TCTATGCGAACG (SEQ ID NO: 2052) |
| ATTTAGGACGAC (SEQ ID NO: 2053) | GCTGTCGTCAAC (SEQ ID NO: 2054) | ACCCGGATTTCG (SEQ ID NO: 2055) | ACAAGGCAAGGC (SEQ ID NO: 2056) | AGCCGGAGAGTA (SEQ ID NO: 2057) | CTATGAGTCCAG (SEQ ID NO: 2058) |
| GGATAGCCAAGG (SEQ ID NO: 2059) | ATAGAGGCCATT (SEQ ID NO: 2060) | CGTCCGTATGAA (SEQ ID NO: 2061) | CGTTAGTGACTG (SEQ ID NO: 2062) | CCTGTAGGTTGC (SEQ ID NO: 2063) | AGTCCTTTATCC (SEQ ID NO: 2064) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TGGTTGGTTACG (SEQ ID NO: 2065) | AAGCTTGAAACC (SEQ ID NO: 2066) | CGATTAGGAATC (SEQ ID NO: 2067) | GCCGTTGATGCT (SEQ ID NO: 2068) | AAGGCCTTTACG (SEQ ID NO: 2069) | AGTTTGCGAGAT (SEQ ID NO: 2070) |
| GTCGTCCAAATG (SEQ ID NO: 2071) | TAAGCGTCTCGA (SEQ ID NO: 2072) | ACGTCTCAGTGC (SEQ ID NO: 2073) | TTCAACCTTTCG (SEQ ID NO: 2074) | CTAGGCAATCAA (SEQ ID NO: 2075) | TCAACGTGCTGC (SEQ ID NO: 2076) |
| CAACGTGCTCCA (SEQ ID NO: 2077) | ATAGCTTCGTGG (SEQ ID NO: 2078) | TAGTAGCACCTG (SEQ ID NO: 2079) | TGGGAGGTGGTA (SEQ ID NO: 2080) | AGGACCTCGTTC (SEQ ID NO: 2081) | GAACCAGTACTC (SEQ ID NO: 2082) |
| TACACAAGTCGC (SEQ ID NO: 2083) | CGGGATCAAATT (SEQ ID NO: 2084) | AGGTCATCTTGG (SEQ ID NO: 2085) | CGCCTGCCAATA (SEQ ID NO: 2086) | CTTGTCTGGAGC (SEQ ID NO: 2087) | TGATAATGCACG (SEQ ID NO: 2088) |
| GCGTCCATGAAT (SEQ ID NO: 2089) | AGTCATCGAATG (SEQ ID NO: 2090) | TGCTGTGACCAC (SEQ ID NO: 2091) | TTGAGCTTGAGC (SEQ ID NO: 2092) | ACCGCATCAATG (SEQ ID NO: 2093) | TAGTGATGACCA (SEQ ID NO: 2094) |
| GTAATGCGTAAC (SEQ ID NO: 2095) | ATCTTGGAGTCG (SEQ ID NO: 2096) | ACACTTCGGCAA (SEQ ID NO: 2097) | TACTAACGCGGT (SEQ ID NO: 2098) | AAGGTCAATCGT (SEQ ID NO: 2099) | ACAGCCACCCAT (SEQ ID NO: 2100) |
| GTCGCCGTACAT (SEQ ID NO: 2101) | AGCACCGGTCTT (SEQ ID NO: 2102) | ACCTCCCGGATA (SEQ ID NO: 2103) | ATCCGCAGTCAC (SEQ ID NO: 2104) | ACCTACTTGTCT (SEQ ID NO: 2105) | TATGTTGACGGC (SEQ ID NO: 2106) |
| GGAATCCGATTA (SEQ ID NO: 2107) | GCAAATCAGCCT (SEQ ID NO: 2108) | GAAGAGGGTTGA (SEQ ID NO: 2109) | AGTGTACCATGA (SEQ ID NO: 2110) | TGTTGGATCGTG (SEQ ID NO: 2111) | CGAGTATACAAC (SEQ ID NO: 2112) |
| CACCCGATGGTT (SEQ ID NO: 2113) | GCAAGCTGTCTC (SEQ ID NO: 2114) | AGTAGACTTACG (SEQ ID NO: 2115) | CCGATTGAATCG (SEQ ID NO: 2116) | ACTGGATCTCGC (SEQ ID NO: 2117) | TACACCTTACCT (SEQ ID NO: 2118) |
| TTCTGAGAGGTA (SEQ ID NO: 2119) | AGCGGCCTATTA (SEQ ID NO: 2120) | TGGAAACCATTG (SEQ ID NO: 2121) | TATATGTGCGAG (SEQ ID NO: 2122) | TCAAGGGACCTT (SEQ ID NO: 2123) | CGTTCAAGCTAG (SEQ ID NO: 2124) |
| ATCCCTACGGAA (SEQ ID NO: 2125) | TCTTCAACTACC (SEQ ID NO: 2126) | AGTCCGAGTTGT (SEQ ID NO: 2127) | CACCCACGTTGA (SEQ ID NO: 2128) | AAGTCGACACAT (SEQ ID NO: 2129) | AACTCGCGCTAC (SEQ ID NO: 2130) |
| GGTTCCATTAGG (SEQ ID NO: 2131) | TGGAATTCGGCT (SEQ ID NO: 2132) | CCGCGATTTCGA (SEQ ID NO: 2133) | TAGTGGGTCAAT (SEQ ID NO: 2134) | AACATTGCAGGT (SEQ ID NO: 2135) | TACCAGGATTGC (SEQ ID NO: 2136) |
| GTGTTCCCAGAA (SEQ ID NO: 2137) | TAAGATGCAGTC (SEQ ID NO: 2138) | ACACACCCTGAC (SEQ ID NO: 2139) | CCTAAACTACGG (SEQ ID NO: 2140) | CCATGAAGTGTA (SEQ ID NO: 2141) | GGTTGTAAGTGT (SEQ ID NO: 2142) |
| CCGAGGTATAAT (SEQ ID NO: 2143) | TGCCGAGTAATC (SEQ ID NO: 2144) | TCACGAGTCACA (SEQ ID NO: 2145) | ACTCCCGTGTGA (SEQ ID NO: 2146) | TCCACAGGGTTC (SEQ ID NO: 2147) | CAACGAACCATC (SEQ ID NO: 2148) |
| AGCGTAATTAGC (SEQ ID NO: 2149) | ACCTTGACAAGA (SEQ ID NO: 2150) | CACAAAGCGATT (SEQ ID NO: 2151) | CTGCAAGCCTGT (SEQ ID NO: 2152) | TCATTAGCGTGG (SEQ ID NO: 2153) | CCATGCTTAGAG (SEQ ID NO: 2154) |
| CTCGTGAATGAC (SEQ ID NO: 2155) | GTAACCACCACC (SEQ ID NO: 2156) | CACCGTGACACT (SEQ ID NO: 2157) | CCAACAGCCAAT (SEQ ID NO: 2158) | ATGTCGAATAGC (SEQ ID NO: 2159) | AATGGCGACTAT (SEQ ID NO: 2160) |
| AGGTGAGTTCTA (SEQ ID NO: 2161) | CATAGCTCGGTC (SEQ ID NO: 2162) | GAAGATCTATCG (SEQ ID NO: 2163) | CGGTTCACATAG (SEQ ID NO: 2164) | CTGACCGTTAAG (SEQ ID NO: 2165) | GACAGGTTGTAT (SEQ ID NO: 2166) |
| CCTGTCCTATCT (SEQ ID NO: 2167) | AACCATGCCAAC (SEQ ID NO: 2168) | GACGGAACAGAC (SEQ ID NO: 2169) | TCAACAGTAGTG (SEQ ID NO: 2170) | TCGGGCTCTTAG (SEQ ID NO: 2171) | GACTATAATGGC (SEQ ID NO: 2172) |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GGTTTAACACGC (SEQ ID NO: 2173) | TATGGAGCTAGT (SEQ ID NO: 2174) | GGACCGCTTTCA (SEQ ID NO: 2175) | AACACATGGGTT (SEQ ID NO: 2176) | ACTTTAAGGGTG (SEQ ID NO: 2177) | TTCAGGAACTAG (SEQ ID NO: 2178) |
| AGACAGTAGGAG (SEQ ID NO: 2179) | ACTACCTCTTCA (SEQ ID NO: 2180) | CACGGTCCTATG (SEQ ID NO: 2181) | ATCGTAGTGGTC (SEQ ID NO: 2182) | TGGACCACTAGT (SEQ ID NO: 2183) | CAACAGGTAACT (SEQ ID NO: 2184) |
| GCCACGACTTAC (SEQ ID NO: 2185) | GATGATAACCCA (SEQ ID NO: 2186) | GAATGACGTTTG (SEQ ID NO: 2187) | CGAGTCACGATT (SEQ ID NO: 2188) | AACCAGCAGATT (SEQ ID NO: 2189) | TAGTTGAGCTGA (SEQ ID NO: 2190) |
| ATTGTTCCTACC (SEQ ID NO: 2191) | GGCCCAATATAA (SEQ ID NO: 2192) | ACTTACGCCACG (SEQ ID NO: 2193) | AGTGCGTTCTAG (SEQ ID NO: 2194) | ATCGAGGATCTA (SEQ ID NO: 2195) | GTCTCAAAGCAC (SEQ ID NO: 2196) |
| GCCGTAAACTTG (SEQ ID NO: 2197) | TTGTATGACAGG (SEQ ID NO: 2198) | ACGCCTTTCTTA (SEQ ID NO: 2199) | TTCTTAACGCCT (SEQ ID NO: 2200) | TAGCTGGCGTTC (SEQ ID NO: 2201) | AGTTGCCTGAAC (SEQ ID NO: 2202) |
| GCAGATTTCCAG (SEQ ID NO: 2203) | GGTAAGTTTGAC (SEQ ID NO: 2204) | TTGGTGCCTGTG (SEQ ID NO: 2205) | ACCCAGTATGGT (SEQ ID NO: 2206) | CACAAGTATCGA (SEQ ID NO: 2207) | TGGTAGTCTGAA (SEQ ID NO: 2208) |
| AGATGATCAGTC (SEQ ID NO: 2209) | CTACCACGGTAC (SEQ ID NO: 2210) | CATCGGATCTGA (SEQ ID NO: 2211) | CGTTAAGTCAGC (SEQ ID NO: 2212) | GATTGTGCAACC (SEQ ID NO: 2213) | GCATGTCGAAAT (SEQ ID NO: 2214) |
| GAGACGTGTTCT (SEQ ID NO: 2215) | CGGTCTGTCTGA (SEQ ID NO: 2216) | CATGTCTTCCAT (SEQ ID NO: 2217) | TCACAACACCGC (SEQ ID NO: 2218) | CTACAGGGTCTC (SEQ ID NO: 2219) | CCTATGCACGGT (SEQ ID NO: 2220) |
| TATCACCGGCAC (SEQ ID NO: 2221) | GTACATGTCGCC (SEQ ID NO: 2222) | GTTACAGTTGGC (SEQ ID NO: 2223) | AGCAAGGTCTTC (SEQ ID NO: 2224) | GTACCAGGTACT (SEQ ID NO: 2225) | GCGTGGTCATTA (SEQ ID NO: 2226) |
| TATGCCAGAGAT (SEQ ID NO: 2227) | TTCTAGAGTGCG (SEQ ID NO: 2228) | CGGACTCGTTAC (SEQ ID NO: 2229) | TCTAAACCCTCT (SEQ ID NO: 2230) | GTATACCCTTCT (SEQ ID NO: 2231) | AGTCACATCCGC (SEQ ID NO: 2232) |
| AGGTCCAAATCA (SEQ ID NO: 2233) | ACGGATGTTATG (SEQ ID NO: 2234) | TCTCGCACTGGA (SEQ ID NO: 2235) | CCTGATCACACG (SEQ ID NO: 2236) | TAGGTCTAGGTC (SEQ ID NO: 2237) | AGCGTCTGAACT (SEQ ID NO: 2238) |
| ACCGTGCTCACA (SEQ ID NO: 2239) | TTGAGGCTACAA (SEQ ID NO: 2240) | TTCTGGTCTTGT (SEQ ID NO: 2241) | AAGCTGCCTAGT (SEQ ID NO: 2242) | GACAGTAGCTTC (SEQ ID NO: 2243) | ATCGCGACTGCT (SEQ ID NO: 2244) |
| CTCCCTTTGTGT (SEQ ID NO: 2245) | GTAGGAACCGGA (SEQ ID NO: 2246) | GTCCACTTGGAC (SEQ ID NO: 2247) | ATTTGTGGGTAG (SEQ ID NO: 2248) | TGAACGTTGGAT (SEQ ID NO: 2249) | TGGAGGTTCTCA (SEQ ID NO: 2250) |
| AGCTGCACCTAA (SEQ ID NO: 2251) | ACATCTAGCAGA (SEQ ID NO: 2252) | GATTTAGAGGCT (SEQ ID NO: 2253) | TACATGGAGCAT (SEQ ID NO: 2254) | AGTGTGAACGTT (SEQ ID NO: 2255) | TGCTTGTAGGCA (SEQ ID NO: 2256) |
| CCTTGACCGATG (SEQ ID NO: 2257) | CCGACATTGTAG (SEQ ID NO: 2258) | GTCAGCCGTTAA (SEQ ID NO: 2259) | GCCTCAGCAGTT (SEQ ID NO: 2260) | ATGGTCACAAAC (SEQ ID NO: 2261) | CTTAAATGGGCA (SEQ ID NO: 2262) |
| CTATCATCCTCA (SEQ ID NO: 2263) | CATGTAAGGCTC (SEQ ID NO: 2264) | ACGGTTTCTGGA (SEQ ID NO: 2265) | CATCTTCTGATC (SEQ ID NO: 2266) | ACATAGCGGTTC (SEQ ID NO: 2267) | GGTATCACCCTG (SEQ ID NO: 2268) |
| ACTCTAGCCGGT (SEQ ID NO: 2269) | TGCAAGCTAAGT (SEQ ID NO: 2270) | GCAGCCATATTG (SEQ ID NO: 2271) | CAGGTTGTGCCT (SEQ ID NO: 2272) | GCTGTTTGACCG (SEQ ID NO: 2273) | CGCCTTGATAAG (SEQ ID NO: 2274) |
| CGATAGGCCTTA (SEQ ID NO: 2275) | GTGTGTGCCATA (SEQ ID NO: 2276) | ATAGGTGTGCTA (SEQ ID NO: 2277) | GGTTGCCCTGTA (SEQ ID NO: 2278) | CGAATACTGACA (SEQ ID NO: 2279) | CGTTTATCCGTT (SEQ ID NO: 2280) |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| AATGACCTCGTG (SEQ ID NO: 2281) | TGACAACCGAAT (SEQ ID NO: 2282) | ACCTAGCTAGTG (SEQ ID NO: 2283) | TGGTTTCGAAGA (SEQ ID NO: 2284) | TATCCTGGTTTC (SEQ ID NO: 2285) | TTGTACTCACTC (SEQ ID NO: 2286) |
| CTTAGGCATGTG (SEQ ID NO: 2287) | TAGGCTCGTGCT (SEQ ID NO: 2288) | GTCCTGACACTG (SEQ ID NO: 2289) | TGCGTTCTAGCG (SEQ ID NO: 2290) | CATTGTCCCTAT (SEQ ID NO: 2291) | TTCCCACCCATT (SEQ ID NO: 2292) |
| CCAGATATAGCA (SEQ ID NO: 2293) | CTCCTTAAGGCG (SEQ ID NO: 2294) | GGACTCAACTAA (SEQ ID NO: 2295) | AGTCCACTGGTA (SEQ ID NO: 2296) | ACCGACGCTTGT (SEQ ID NO: 2297) | GCCGCATTCGAT (SEQ ID NO: 2298) |
| GAGAGTCCACTT (SEQ ID NO: 2299) | TTGCCTGGGTCA (SEQ ID NO: 2300) | ATACGGGTTCGT (SEQ ID NO: 2301) | GAACTCGCTATG (SEQ ID NO: 2302) | CTGTGATCGGAT (SEQ ID NO: 2303) | |
| GAACGGGACGTA (SEQ ID NO: 2304) | CAATTCTGCTTC (SEQ ID NO: 2305) | CCTTTCACCTGT (SEQ ID NO: 2306) | GGTAGTTCATAG (SEQ ID NO: 2307) | ATGTACACCGGT (SEQ ID NO: 2308) | |
| ACGTGTAGGCTT (SEQ ID NO: 2309) | ACTGGCAAACCT (SEQ ID NO: 2310) | ATCAGCCAGCTC (SEQ ID NO: 2311) | AGGATGGGATGC (SEQ ID NO: 2312) | TAAGCTAAACCG (SEQ ID NO: 2313) | |
| GGTCTCCTACAG (SEQ ID NO: 2314) | AATCAGAGCTTG (SEQ ID NO: 2315) | GCTCCACAACGT (SEQ ID NO: 2316) | CAGTGATACTGC (SEQ ID NO: 2317) | CATTGGGAGTTC (SEQ ID NO: 2318) | |
| ACTGACTTAAGG (SEQ ID NO: 2319) | CAATGTAGACAC (SEQ ID NO: 2320) | AAGGAGTGCGCA (SEQ ID NO: 2321) | GAGGATACTACT (SEQ ID NO: 2322) | GATCGGTTAATG (SEQ ID NO: 2323) | |
| GATGCTGCCGTT (SEQ ID NO: 2324) | TGGCGATACGTT (SEQ ID NO: 2325) | AGGGAAAGGATC (SEQ ID NO: 2326) | GCATCGTCTGGT (SEQ ID NO: 2327) | CAGCGACTGTTA (SEQ ID NO: 2328) | |
| TTCCTAGGCCAG (SEQ ID NO: 2329) | GCCTTACGATAG (SEQ ID NO: 2330) | ACGACGCATTTG (SEQ ID NO: 2331) | TATGGGTAGCTA (SEQ ID NO: 2332) | GAGCCCAAAGAG (SEQ ID NO: 2333) | |
| ATTAAGCCTGGA (SEQ ID NO: 2334) | TACCTGTGTCTT (SEQ ID NO: 2335) | CGTCACTCCAAG (SEQ ID NO: 2336) | AGGTATTACCGA (SEQ ID NO: 2337) | CGATCACCACAA (SEQ ID NO: 2338) | |
| TGGCTTTCTATC (SEQ ID NO: 2339) | AACGAGGCAACG (SEQ ID NO: 2340) | TTACACAAAGGC (SEQ ID NO: 2341) | TGTCAAAGTGAC (SEQ ID NO: 2342) | CTAGAGCTCCCA (SEQ ID NO: 2343) | |
| ACAGCTCAAACA (SEQ ID NO: 2344) | GAAGACAGCGAC (SEQ ID NO: 2345) | GTATAGTCCGTG (SEQ ID NO: 2346) | GTAACGGCTCTA (SEQ ID NO: 2347) | GAACGCAATTCC (SEQ ID NO: 2348) | |
| GAGCGTATCCAT (SEQ ID NO: 2349) | ACACCTGCGATC (SEQ ID NO: 2350) | TCGTAAGCCGTC (SEQ ID NO: 2351) | GTGTACATAACG (SEQ ID NO: 2352) | ATCCGTCTGACG (SEQ ID NO: 2353) | |
| ATGGGCGAATGG (SEQ ID NO: 2354) | GGCGTTGCATTC (SEQ ID NO: 2355) | TGACGCCTCCAA (SEQ ID NO: 2356) | TGCTGCTCAACG (SEQ ID NO: 2357) | TGAAATGTCCCG (SEQ ID NO: 2358) | |
| GATCTCTGGGTA (SEQ ID NO: 2359) | ACTAGCGTTCAG (SEQ ID NO: 2360) | TTCTCGGTTCTC (SEQ ID NO: 2361) | CGGATGCAAGAG (SEQ ID NO: 2362) | ATTCGCCAAGAA (SEQ ID NO: 2363) | |
| CATCATACGGGT (SEQ ID NO: 2364) | TTGCGACAAAGT (SEQ ID NO: 2365) | GCTACTGGTATG (SEQ ID NO: 2366) | TGACATTCACGG (SEQ ID NO: 2367) | TACGTGATCCCG (SEQ ID NO: 2368) | |
| TACGGATTATGG (SEQ ID NO: 2369) | TGCGAGTATATG (SEQ ID NO: 2370) | GAATCCTCACCG (SEQ ID NO: 2371) | CACATATTGGGC (SEQ ID NO: 2372) | TGGGTAGATCTC (SEQ ID NO: 2373) | |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| ATAGCGAACTCA (SEQ ID NO: 2374) | TACCACAACGAA (SEQ ID NO: 2375) | CCTGACACACAC (SEQ ID NO: 2376) | TTCAATAGGGAC (SEQ ID NO: 2377) | AGCAATCGGTAT (SEQ ID NO: 2378) | |
| TAACGCTGTGTG (SEQ ID NO: 2379) | TCTGGAACGGTT (SEQ ID NO: 2380) | CAGCGTTTAGCC (SEQ ID NO: 2381) | ATAGCCGATGTC (SEQ ID NO: 2382) | GTTGGACGAAGG (SEQ ID NO: 2383) | |
| AACCAAACTCGA (SEQ ID NO: 2384) | GTACTACCTCGG (SEQ ID NO: 2385) | GGTATGGCTACT (SEQ ID NO: 2386) | ATGCGTAATGCA (SEQ ID NO: 2387) | ACACTATGAAGC (SEQ ID NO: 2388) | |
| GCCGTCTCGTAA (SEQ ID NO: 2389) | TTCCTGTTAACC (SEQ ID NO: 2390) | ACAATGTCACAG (SEQ ID NO: 2391) | ACTCCGATAGAC (SEQ ID NO: 2392) | ACGGAAATCCCT (SEQ ID NO: 2393) | |
| CTGGGTATCTCG (SEQ ID NO: 2394) | CTATCCAAGTGG (SEQ ID NO: 2395) | GCCATAGTGTGT (SEQ ID NO: 2396) | GCTGAGCCTTTG (SEQ ID NO: 2397) | GGTTTCTATCCT (SEQ ID NO: 2398) | |
| GACTACCCGTTG (SEQ ID NO: 2399) | CAGTCTAGTACG (SEQ ID NO: 2400) | GGTCCCGAAATT (SEQ ID NO: 2401) | AACAGAGAGAGC (SEQ ID NO: 2402) | ACGCAATGTCTG (SEQ ID NO: 2403) | |
| GCGTTGCAAACT (SEQ ID NO: 2404) | GTGTCCGGATTC (SEQ ID NO: 2405) | TCTGCGAGTCTG (SEQ ID NO: 2406) | AATTCCGAACGC (SEQ ID NO: 2407) | TCGGTTACGCTG (SEQ ID NO: 2408) | |
| AACCGCATAAGT (SEQ ID NO: 2409) | TGTGGTGATGTA (SEQ ID NO: 2410) | ATGTAGGCTTAG (SEQ ID NO: 2411) | TTAGTACGCAGA (SEQ ID NO: 2412) | AAGCCATTGAAC (SEQ ID NO: 2413) | |
| ACCTTACACCTT (SEQ ID NO: 2414) | CTTTCGTTCAAC (SEQ ID NO: 2415) | TGCTTCCAATTC (SEQ ID NO: 2416) | GAATCTGACAAC (SEQ ID NO: 2417) | CGATTGTTCCGG (SEQ ID NO: 2418) | |
| GTAGGTGCTTAC (SEQ ID NO: 2419) | CCGAAGATTCTG (SEQ ID NO: 2420) | GCCGAGATAATT (SEQ ID NO: 2421) | CACACTGAAGTC (SEQ ID NO: 2422) | CCTAAGAGCATC (SEQ ID NO: 2423) | |
| CGCATTTGGATG (SEQ ID NO: 2424) | GTTGGCGTTACA (SEQ ID NO: 2425) | TCGAGTATCGAA (SEQ ID NO: 2426) | ACTATCAGTGGC (SEQ ID NO: 2427) | GATGGTTTCAGC (SEQ ID NO: 2428) | |
| ATAACATGTGCG (SEQ ID NO: 2429) | GAAGTAGCGAGC (SEQ ID NO: 2430) | GCCCTATCTTCT (SEQ ID NO: 2431) | AGACTCAGACTC (SEQ ID NO: 2432) | TAATTGCAGAGC (SEQ ID NO: 2433) | |
| CTTGAGAAATCG (SEQ ID NO: 2434) | TTGCGGACCCTA (SEQ ID NO: 2435) | AGGTACGCAATT (SEQ ID NO: 2436) | GACCTTTCAAGG (SEQ ID NO: 2437) | TACCGGCTTGCA (SEQ ID NO: 2438) | |
| CTACACAGCACA (SEQ ID NO: 2439) | GCGGAAACATGG (SEQ ID NO: 2440) | GTCCCTATTATC (SEQ ID NO: 2441) | CAAGCAGGTGAG (SEQ ID NO: 2442) | AGTCGGCATCTC (SEQ ID NO: 2443) | |
| GAAATGCTACGT (SEQ ID NO: 2444) | AACGTTAGTGTG (SEQ ID NO: 2445) | TGGGACATATCC (SEQ ID NO: 2446) | GGAGAACGACAC (SEQ ID NO: 2447) | ATATACCTGCGG (SEQ ID NO: 2448) | |
| TCTGAGGTTGCC (SEQ ID NO: 2449) | TGCATGACAGTC (SEQ ID NO: 2450) | GAACGATCATGT (SEQ ID NO: 2451) | CAGCTTCGACTG (SEQ ID NO: 2452) | TGTCTGACGCAA (SEQ ID NO: 2453) | |
| GATCATTCTCTC (SEQ ID NO: 2454) | TCAATCGCTTTC (SEQ ID NO: 2455) | TTCAGACCAGCC (SEQ ID NO: 2456) | ATCTTTCCCTGA (SEQ ID NO: 2457) | CATATCCAGCCG (SEQ ID NO: 2458) | |
| AGACATACCGTA (SEQ ID NO: 2459) | CTACCGATTGCG (SEQ ID NO: 2460) | ACGCATCGCACT (SEQ ID NO: 2461) | CTCCGAACAACA (SEQ ID NO: 2462) | TCTCACTGTTCC (SEQ ID NO: 2463) | |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GATCCTCATGCG (SEQ ID NO: 2464) | TCACCCAAGGTA (SEQ ID NO: 2465) | CAGTAGCGATAT (SEQ ID NO: 2466) | GGTCACACATCA (SEQ ID NO: 2467) | GCTATGGAACTC (SEQ ID NO: 2468) | |
| ATTATCGTCCCT (SEQ ID NO: 2469) | AGCCAGTCATAC (SEQ ID NO: 2470) | GGATACTCGCAT (SEQ ID NO: 2471) | AGAACTTGACGT (SEQ ID NO: 2472) | CTCCACATTCCT (SEQ ID NO: 2473) | |
| CCAGACCGCTAT (SEQ ID NO: 2474) | TAACGGCGCTCT (SEQ ID NO: 2475) | CTAAGTTGCAAG (SEQ ID NO: 2476) | CTTGAACCCGAC (SEQ ID NO: 2477) | TACGTTTGGCGA (SEQ ID NO: 2478) | |
| AGCTCTAGAAAC (SEQ ID NO: 2479) | GTTTGCTCGAGA (SEQ ID NO: 2480) | CGCGATATCGTC (SEQ ID NO: 2481) | GACGTGTCCATC (SEQ ID NO: 2482) | AATCGCCCTTGG (SEQ ID NO: 2483) | |
| TCCATCGACGTG (SEQ ID NO: 2484) | CAAACGCACTAA (SEQ ID NO: 2485) | CTGATGTACACG (SEQ ID NO: 2486) | AGAGCCAAGAGC (SEQ ID NO: 2487) | CGGCGATGAAAG (SEQ ID NO: 2488) | |
| CGATGTGTGGTT (SEQ ID NO: 2489) | GAACAAAGAGCG (SEQ ID NO: 2490) | AGGCATCTGCTC (SEQ ID NO: 2491) | TGGGAATGTTGT (SEQ ID NO: 2492) | CCGCTACGTGAT (SEQ ID NO: 2493) | |
| GCGAAGTTGGGA (SEQ ID NO: 2494) | GCTAAGTGATGT (SEQ ID NO: 2495) | AGACCTGACCCT (SEQ ID NO: 2496) | CAATCATAGGTG (SEQ ID NO: 2497) | CTGGTAAGTCCA (SEQ ID NO: 2498) | |
| GCATTCGGCGTT (SEQ ID NO: 2499) | AAGGGACAAGTG (SEQ ID NO: 2500) | CATCGACGAGTT (SEQ ID NO: 2501) | ATAAGTAACCGC (SEQ ID NO: 2502) | AGAGCTCCTCTG (SEQ ID NO: 2503) | |
| CGCCATTGTGCA (SEQ ID NO: 2504) | AGTGTCGATTCG (SEQ ID NO: 2505) | GGAGTTGAGGTG (SEQ ID NO: 2506) | GACTTGGTAAAC (SEQ ID NO: 2507) | GACAAACCTTGC (SEQ ID NO: 2508) | |
| TCCAACTGCAGA (SEQ ID NO: 2509) | CTATTAAGCGGC (SEQ ID NO: 2510) | AGCATCCCTAAG (SEQ ID NO: 2511) | AATCACGGTGCT (SEQ ID NO: 2512) | CATTAGCTGGAA (SEQ ID NO: 2513) | |
| TAAAGACCCGTA (SEQ ID NO: 2514) | CCTACCATTGTT (SEQ ID NO: 2515) | CAGACGAGGAAC (SEQ ID NO: 2516) | ACGACCTACGCT (SEQ ID NO: 2517) | CCACAACGATCA (SEQ ID NO: 2518) | |
| TGTATCTTCACC (SEQ ID NO: 2519) | GAGTCCGTTGCT (SEQ ID NO: 2520) | TCGCTACAGATG (SEQ ID NO: 2521) | GATGTCATAGCC (SEQ ID NO: 2522) | CCGGTGTGATTC (SEQ ID NO: 2523) | |
| GACTGACTCGTC (SEQ ID NO: 2524) | GATAACTGTACG (SEQ ID NO: 2525) | TCGGTGTACCAA (SEQ ID NO: 2526) | TGTTGCGTTTCT (SEQ ID NO: 2527) | ATAGTGTTCGGC (SEQ ID NO: 2528) | |
| TCGTGGATAGCT (SEQ ID NO: 2529) | TAAACCTGGACA (SEQ ID NO: 2530) | AACACGGTTTGA (SEQ ID NO: 2531) | GCATACTACAGC (SEQ ID NO: 2532) | TAATCTCGCCGG (SEQ ID NO: 2533) | |
| GACGCACTAACT (SEQ ID NO: 2534) | CCGAATTGACAA (SEQ ID NO: 2535) | CTTGTGCGACAA (SEQ ID NO: 2536) | GAGGTATTCTGA (SEQ ID NO: 2537) | CAGATCCCAACC (SEQ ID NO: 2538) | |
| GGCGATTTACGT (SEQ ID NO: 2539) | CTGGCATCTAGC (SEQ ID NO: 2540) | AGAGTAAGCCGG (SEQ ID NO: 2541) | ATGTTCCTCATC (SEQ ID NO: 2542) | AGAGATTATGCC (SEQ ID NO: 2543) | |
| TAAGGCATCGCT (SEQ ID NO: 2544) | GGTGGTCGTTCT (SEQ ID NO: 2545) | AGACACCAATGT (SEQ ID NO: 2546) | CGGTATAGCAAT (SEQ ID NO: 2547) | TGAATACCTGGC (SEQ ID NO: 2548) | |
| ACCCATACAGCC (SEQ ID NO: 2549) | ACTATGGGCTAA (SEQ ID NO: 2550) | AATACGTCAAGC (SEQ ID NO: 2551) | CTTGGCCTGTAG (SEQ ID NO: 2552) | CTCCCACTAGAG (SEQ ID NO: 2553) | |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| CGCACTACGCAT (SEQ ID NO: 2554) | GCATTGAGTTCG (SEQ ID NO: 2555) | ATGGCAATTCAG (SEQ ID NO: 2556) | ATCAAACGCATG (SEQ ID NO: 2557) | AGCCCTGCTACA (SEQ ID NO: 2558) | |
| CAGTCGTTAAGA (SEQ ID NO: 2559) | GTTGCTGAGTCC (SEQ ID NO: 2560) | CAGTGTCATGAA (SEQ ID NO: 2561) | CGGTCCTGAGTT (SEQ ID NO: 2562) | CCTTATAGAAGG (SEQ ID NO: 2563) | |
| CTACGAAAGCCT (SEQ ID NO: 2564) | CTATGGTGAACC (SEQ ID NO: 2565) | CGGTGACCTACT (SEQ ID NO: 2566) | CTCGAGCGTACT (SEQ ID NO: 2567) | GGCCAAGGAAGT (SEQ ID NO: 2568) | |
| ATAATTGCCGAG (SEQ ID NO: 2569) | GGACCAAGGGAT (SEQ ID NO: 2570) | ACATCCCTACTT (SEQ ID NO: 2571) | TTAAGGACTGAC (SEQ ID NO: 2572) | CCTCTACTCTAA (SEQ ID NO: 2573) | |
| GGCATGTTATCG (SEQ ID NO: 2574) | GTATTGGTCAGA (SEQ ID NO: 2575) | TGAAGCACACTA (SEQ ID NO: 2576) | GTGGAAGAGACA (SEQ ID NO: 2577) | GAGTCGATCTTG (SEQ ID NO: 2578) | |
| AGGCACAGTAGG (SEQ ID NO: 2579) | AGAACCGTCATA (SEQ ID NO: 2580) | GTGAATGTTCGA (SEQ ID NO: 2581) | TAACTAGGACGT (SEQ ID NO: 2582) | GACCTACCGCAT (SEQ ID NO: 2583) | |
| CTACTTACATCC (SEQ ID NO: 2584) | AACTGGAACCCT (SEQ ID NO: 2585) | AGTCGCTACACA (SEQ ID NO: 2586) | GAAAGAGTCTCT (SEQ ID NO: 2587) | ATGTAATAGGCC (SEQ ID NO: 2588) | |
| CTCTTCTGATCA (SEQ ID NO: 2589) | ATACTCGGCTGC (SEQ ID NO: 2590) | AACCACTAACCG (SEQ ID NO: 2591) | TCACCGGAATCC (SEQ ID NO: 2592) | GACTCGCAACTA (SEQ ID NO: 2593) | |
| ATGCTAACCACG (SEQ ID NO: 2594) | ACGCTTAACGAC (SEQ ID NO: 2595) | TTCGCTAACCTT (SEQ ID NO: 2596) | CGACTGCAGCTT (SEQ ID NO: 2597) | CTGACGATCCGT (SEQ ID NO: 2598) | |
| ACCAATCTCGGC (SEQ ID NO: 2599) | AGCTTACCGACC (SEQ ID NO: 2600) | GACACTCACCGT (SEQ ID NO: 2601) | GTTACCCGAGCT (SEQ ID NO: 2602) | GTGCGAGGACAA (SEQ ID NO: 2603) | |
| TATCCAAGCGCA (SEQ ID NO: 2604) | AGGGCTATAGTT (SEQ ID NO: 2605) | TCAGAGTAGACT (SEQ ID NO: 2606) | CCTAGGTCCCAA (SEQ ID NO: 2607) | GCAGAGAGGCTA (SEQ ID NO: 2608) | |
| GTACTGAAGATC (SEQ ID NO: 2609) | TGTCTCGCAAGC (SEQ ID NO: 2610) | GACCAAATGTCC (SEQ ID NO: 2611) | TTGAGTGGTCTG (SEQ ID NO: 2612) | TCCTTGTCCTTG (SEQ ID NO: 2613) | |
| TCGCCGTGTACA (SEQ ID NO: 2614) | CAGCCGCATATC (SEQ ID NO: 2615) | GATGCAACTTCG (SEQ ID NO: 2616) | CGACGAGATTAT (SEQ ID NO: 2617) | CTACAATTGAGG (SEQ ID NO: 2618) | |
| AACTGCGATATG (SEQ ID NO: 2619) | GATACGTTCGCA (SEQ ID NO: 2620) | CACCACAGAATC (SEQ ID NO: 2621) | AGTACTGCCTGC (SEQ ID NO: 2622) | GTTGACCATCGC (SEQ ID NO: 2623) | |
| CTTCCAACTCAT (SEQ ID NO: 2624) | CCAAGATTCGCC (SEQ ID NO: 2625) | GGAGCTCTGTAT (SEQ ID NO: 2626) | GAAGTCCACACT (SEQ ID NO: 2627) | CAATGAGGGAGA (SEQ ID NO: 2628) | |
| GAGATCGCCTAT (SEQ ID NO: 2629) | GAGGCTGATTTA (SEQ ID NO: 2630) | CCTTAAGGGCAT (SEQ ID NO: 2631) | GTAGAATGCTCC (SEQ ID NO: 2632) | AAGCAACGGTGG (SEQ ID NO: 2633) | |
| TGTACATCGCCG (SEQ ID NO: 2634) | GAGTTAGCATCA (SEQ ID NO: 2635) | GCTGCTACAAGT (SEQ ID NO: 2636) | ACACCCTATCGG (SEQ ID NO: 2637) | CTCCAATGACGC (SEQ ID NO: 2638) | |
| TGTTAAGCAGCA (SEQ ID NO: 2639) | TGTAGTATAGGC (SEQ ID NO: 2640) | GTAAACGACTTG (SEQ ID NO: 2641) | AGGAGGATAAAG (SEQ ID NO: 2642) | ATGGAAGGTGGC (SEQ ID NO: 2643) | |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| ACGGCGTTATGT (SEQ ID NO: 2644) | CTCACGCAATGC (SEQ ID NO: 2645) | CGCCCTCTTCTT (SEQ ID NO: 2646) | GCATGGGTTATC (SEQ ID NO: 2647) | CCGGCTTATGTG (SEQ ID NO: 2648) | |
| ACTTTGCTTTGC (SEQ ID NO: 2649) | GTCCCGTGAAAT (SEQ ID NO: 2650) | ACTAGACGACTA (SEQ ID NO: 2651) | GTTCCCAACGGT (SEQ ID NO: 2652) | CTGTGCAACGTC (SEQ ID NO: 2653) | |
| CAAAGCGGTATT (SEQ ID NO: 2654) | GGACAGTGTATT (SEQ ID NO: 2655) | AGGTTAAGTGCT (SEQ ID NO: 2656) | GTCAGAGTATTG (SEQ ID NO: 2657) | AGTCAATGGCCT (SEQ ID NO: 2658) | |
| CGAAACTACGTA (SEQ ID NO: 2659) | ACACGACTATAG (SEQ ID NO: 2660) | ATATCCTGGGAC (SEQ ID NO: 2661) | ATGACAGAACCT (SEQ ID NO: 2662) | GGAACACATGTT (SEQ ID NO: 2663) | |
| GAGGACCAGCAA (SEQ ID NO: 2664) | GTGTAGGTGCTT (SEQ ID NO: 2665) | TTGTAGCCGACA (SEQ ID NO: 2666) | ACAAGTGCTGCT (SEQ ID NO: 2667) | AGCGCATATCCA (SEQ ID NO: 2668) | |
| AATAGCATGTCG (SEQ ID NO: 2669) | TGAACTAGCGTC (SEQ ID NO: 2670) | TCAGAAGCTCAA (SEQ ID NO: 2671) | AATAGTCGTGAC (SEQ ID NO: 2672) | TGCAACTTGCAG (SEQ ID NO: 2673) | |
| CGGAGTAATCCT (SEQ ID NO: 2674) | TCCGAGTCACCA (SEQ ID NO: 2675) | ACTGTGACGTCC (SEQ ID NO: 2676) | TACAAGTGGTCC (SEQ ID NO: 2677) | GTGTGGCAGAAG (SEQ ID NO: 2678) | |
| CTGTGTCCATGG (SEQ ID NO: 2679) | TCCTCTTTGGTC (SEQ ID NO: 2680) | TTGCAGTGCAAC (SEQ ID NO: 2681) | GCTGGTCTAGTC (SEQ ID NO: 2682) | GTGACCCTGTCA (SEQ ID NO: 2683) | |
| CTTCGCGGATGT (SEQ ID NO: 2684) | TCCACCCTCTAT (SEQ ID NO: 2685) | TGTCATGGCTGA (SEQ ID NO: 2686) | GGCATCCTGGTT (SEQ ID NO: 2687) | CACGCAGTCTAC (SEQ ID NO: 2688) | |
| ATAGGCTGTAGT (SEQ ID NO: 2689) | TCGTGACGCTAA (SEQ ID NO: 2690) | TTCGTGAGGATA (SEQ ID NO: 2691) | GTGCCTCAGGTT (SEQ ID NO: 2692) | TTCACTGTGCGG (SEQ ID NO: 2693) | |
| TGTGTAGCCATG (SEQ ID NO: 2694) | ACGGCTAGTTCC (SEQ ID NO: 2695) | TCCCAACCTAGG (SEQ ID NO: 2696) | ATTACAGCGACA (SEQ ID NO: 2697) | AACGAATACCAC (SEQ ID NO: 2698) | |
| AAGGGCGCTGAA (SEQ ID NO: 2699) | GCACTGGCATAT (SEQ ID NO: 2700) | TAGAATCAACGC (SEQ ID NO: 2701) | ATGCAGAGATCT (SEQ ID NO: 2702) | ATGGTTCACCCG (SEQ ID NO: 2703) | |
| GTTTCCGTGGTG (SEQ ID NO: 2704) | GGCATTAGTTGA (SEQ ID NO: 2705) | CACAATACACCG (SEQ ID NO: 2706) | CGTATGCCGTAC (SEQ ID NO: 2707) | TAGCGGAAGACG (SEQ ID NO: 2708) | |
| AGGAACCAGACG (SEQ ID NO: 2709) | CGGTAGTTGATC (SEQ ID NO: 2710) | GTATGACTAGCA (SEQ ID NO: 2711) | AGCCGACTCTGT (SEQ ID NO: 2712) | CCTCATGCTATT (SEQ ID NO: 2713) | |
| TAATGCCCAGGT (SEQ ID NO: 2714) | TGAAAGCGGCGA (SEQ ID NO: 2715) | ATGCTCTAGAGA (SEQ ID NO: 2716) | CTATTCTTGGCT (SEQ ID NO: 2717) | CCATCTTACCAT (SEQ ID NO: 2718) | |
| TATGAACGTCCG (SEQ ID NO: 2719) | GGTTACGGTTAC (SEQ ID NO: 2720) | AGCTAGCGTTCA (SEQ ID NO: 2721) | TCGGTAGCAACT (SEQ ID NO: 2722) | TATGCTCTCTCA (SEQ ID NO: 2723) | |
| CCACATTGGGTC (SEQ ID NO: 2724) | ACATCAGGTCAC (SEQ ID NO: 2725) | GGTCTTAGCACC (SEQ ID NO: 2726) | CCAAATGATGAC (SEQ ID NO: 2727) | CGTGTAGTAGAT (SEQ ID NO: 2728) | |
| TCAGTCAGATGA (SEQ ID NO: 2729) | GTTGATACGATG (SEQ ID NO: 2730) | TACCATCCATCT (SEQ ID NO: 2731) | GCAGGTAACATT (SEQ ID NO: 2732) | ACATGGGCGGAA (SEQ ID NO: 2733) | |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| AAGTCACACACA (SEQ ID NO: 2734) | CAGACACTTCCG (SEQ ID NO: 2735) | AGGGATGGACCA (SEQ ID NO: 2736) | GCACGTTCTACG (SEQ ID NO: 2737) | CCGCTGATGTCA (SEQ ID NO: 2738) | |
| GCTGTGATTCGA (SEQ ID NO: 2739) | TCACCATCCGAG (SEQ ID NO: 2740) | ACTAATACGCGA (SEQ ID NO: 2741) | GACTGGAGATGG (SEQ ID NO: 2742) | ACGAGTTTACCG (SEQ ID NO: 2743) | |
| CTAGCTATGGAC (SEQ ID NO: 2744) | ACCCACCACTAG (SEQ ID NO: 2745) | TCATACAGCCAG (SEQ ID NO: 2746) | ACTAAGTACCCG (SEQ ID NO: 2747) | GGAGATTGGAGA (SEQ ID NO: 2748) | |
| CTTGACGAGGTT (SEQ ID NO: 2749) | CAGAAGGTGTGG (SEQ ID NO: 2750) | GGAGGCCATAAG (SEQ ID NO: 2751) | TAAGTGAGTACC (SEQ ID NO: 2752) | AAGCCCAGCATT (SEQ ID NO: 2753) | |
| ACCTGGGAATAT (SEQ ID NO: 2754) | GAAGCTTGAATC (SEQ ID NO: 2755) | GTCCGATCCTAG (SEQ ID NO: 2756) | ATCGACAACACC (SEQ ID NO: 2757) | GGTGAAACCTAT (SEQ ID NO: 2758) | |
| CTCTGCCTAATT (SEQ ID NO: 2759) | ACTAGGATCAGT (SEQ ID NO: 2760) | CTGTGGGATTCA (SEQ ID NO: 2761) | AGCACACTACAC (SEQ ID NO: 2762) | TGGTAAGAGTCT (SEQ ID NO: 2763) | |
| ATATGACCCAGC (SEQ ID NO: 2764) | GCTCCTTAGAAG (SEQ ID NO: 2765) | TTGTCTACCTAC (SEQ ID NO: 2766) | GAATGTTGCGCT (SEQ ID NO: 2767) | GCGCTTAGAATA (SEQ ID NO: 2768) | |
| CTCTATTCCACC (SEQ ID NO: 2769) | TCCCATTCCCAT (SEQ ID NO: 2770) | GAAGGCTCCTTA (SEQ ID NO: 2771) | CGCGCAAGTATT (SEQ ID NO: 2772) | AGGTGTATCACC (SEQ ID NO: 2773) | |
| ATTGAGTGAGTC (SEQ ID NO: 2774) | TGGCGTCATTCG (SEQ ID NO: 2775) | AGATTACAACCG (SEQ ID NO: 2776) | ATAGTTAGGGCT (SEQ ID NO: 2777) | ATTGTCAAGCAG (SEQ ID NO: 2778) | |
| TTATGGTACGGA (SEQ ID NO: 2779) | AATCCTCGGAGT (SEQ ID NO: 2780) | TCTTCTGCCCTA (SEQ ID NO: 2781) | GTTCAACAGCTG (SEQ ID NO: 2782) | TTCGCAGATACG (SEQ ID NO: 2783) | |
| GCTAGTTATGGA (SEQ ID NO: 2784) | CTGGACGCATTA (SEQ ID NO: 2785) | TGAAGTCACAGT (SEQ ID NO: 2786) | TCAGCAAATGGT (SEQ ID NO: 2787) | CATAGGCCATCA (SEQ ID NO: 2788) | |
| CAGATTAACCAG (SEQ ID NO: 2789) | ACCGATTAGGTA (SEQ ID NO: 2790) | CTTAGTGCAGAA (SEQ ID NO: 2791) | AGGGACTTCAAT (SEQ ID NO: 2792) | CCTTGGAATCGC (SEQ ID NO: 2793) | |
| GGCTGCATACTC (SEQ ID NO: 2794) | ATGTGCTGCTCG (SEQ ID NO: 2795) | CATCAGTACGCC (SEQ ID NO: 2796) | GAAGTGTATCTG (SEQ ID NO: 2797) | CACTTGCTCTCT (SEQ ID NO: 2798) | |
| TTGGTAAAGTGC (SEQ ID NO: 2799) | TACGTACGAAAC (SEQ ID NO: 2800) | TAGAACACCATG (SEQ ID NO: 2801) | TCCTGTGCGAGT (SEQ ID NO: 2802) | GCAACTTCGGTA (SEQ ID NO: 2803) | |
| AAGTGGCTATCC (SEQ ID NO: 2804) | ATCACATTCTCC (SEQ ID NO: 2805) | CCGCATGACCTA (SEQ ID NO: 2806) | CCAACGTAACCA (SEQ ID NO: 2807) | GCCAATCCAACA (SEQ ID NO: 2808) | |
| AACCGATGTACC (SEQ ID NO: 2809) | AGCCTGGTACCT (SEQ ID NO: 2810) | GAGAATGGAAAG (SEQ ID NO: 2811) | AAGGTGGACAAG (SEQ ID NO: 2812) | CTGGAACATTAG (SEQ ID NO: 2813) | |
| TCGATTGGCCGT (SEQ ID NO: 2814) | GCTAAAGTCGTA (SEQ ID NO: 2815) | AACCCTAACTGG (SEQ ID NO: 2816) | CAATTGCGTGCA (SEQ ID NO: 2817) | TTAGCCCAGCGT (SEQ ID NO: 2818) | |
| GCATTACTGGAC (SEQ ID NO: 2819) | TCTCAGCGCGTA (SEQ ID NO: 2820) | TCCATACCGGAA (SEQ ID NO: 2821) | ACCAGCTCAGAT (SEQ ID NO: 2822) | AATGGTTCAGCA (SEQ ID NO: 2823) | |

TABLE 1-continued (SEQ ID NOS 775-2938, respectively, in order of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| TTGGGCCACATA (SEQ ID NO: 2824) | GACCCTAGACCT (SEQ ID NO: 2825) | GTTCAGACTAGC (SEQ ID NO: 2826) | ACGGTACCCTAC (SEQ ID NO: 2827) | CAGCAAGAGGAC (SEQ ID NO: 2828) | |
| CACACAAAGTCA (SEQ ID NO: 2829) | TATTCAGCGGAC (SEQ ID NO: 2830) | GACACCACAATA (SEQ ID NO: 2831) | TCATAGGGTAGT (SEQ ID NO: 2832) | CTAGTACAAGCC (SEQ ID NO: 2833) | |
| GCCAAGGATAGG (SEQ ID NO: 2834) | GTTCCGGATTAG (SEQ ID NO: 2835) | CGATTTAGGCCA (SEQ ID NO: 2836) | ATGGAGTTGTTG (SEQ ID NO: 2837) | AGAGCGGAACAA (SEQ ID NO: 2838) | |
| CGCCACGTGTAT (SEQ ID NO: 2839) | GCGTGTAATTAG (SEQ ID NO: 2840) | AGGATATTCGTG (SEQ ID NO: 2841) | CGTATCTCAGGA (SEQ ID NO: 2842) | GCAGTTGCCTCA (SEQ ID NO: 2843) | |
| GCAACCGATTGT (SEQ ID NO: 2844) | CTGTAGCTTGGC (SEQ ID NO: 2845) | CAATACGACCGT (SEQ ID NO: 2846) | TAGTTCGGTGAC (SEQ ID NO: 2847) | CGCGCCTTAAAC (SEQ ID NO: 2848) | |
| CATGTGCTTAGG (SEQ ID NO: 2849) | ATGCCTCGTAAG (SEQ ID NO: 2850) | GCCATGTGTGTA (SEQ ID NO: 2851) | CCATGGCTGTGT (SEQ ID NO: 2852) | TCCGCGCAAGTT (SEQ ID NO: 2853) | |
| GTTCCTCCATTA (SEQ ID NO: 2854) | ACCTATGGTGAA (SEQ ID NO: 2855) | GACTCCTAGACC (SEQ ID NO: 2856) | CTAGTCGCTGGT (SEQ ID NO: 2857) | TAACCACCAACG (SEQ ID NO: 2858) | |
| ACCTGTCCTTTC (SEQ ID NO: 2859) | CTGTTACAGCGA (SEQ ID NO: 2860) | AAGGCAAGAAGA (SEQ ID NO: 2861) | TCCAAGCGTCAC (SEQ ID NO: 2862) | TGCGTCAGCTAC (SEQ ID NO: 2863) | |
| GTTCACGCCCAA (SEQ ID NO: 2864) | CAGTCAGGCCTT (SEQ ID NO: 2865) | ACGAGGAGTCGA (SEQ ID NO: 2866) | GCTTCATTTCTG (SEQ ID NO: 2867) | CGAAATGCATGT (SEQ ID NO: 2868) | |
| CGATCGAACACT (SEQ ID NO: 2869) | ACTGAGCTGCAT (SEQ ID NO: 2870) | GCGGTACTACTA (SEQ ID NO: 2871) | AACTTGGCCGTA (SEQ ID NO: 2872) | ATGATCGGTACA (SEQ ID NO: 2873) | |
| CATGCCAACATG (SEQ ID NO: 2874) | ACGAAGTCTACC (SEQ ID NO: 2875) | TCAGCTGACTAG (SEQ ID NO: 2876) | CATACGATACAG (SEQ ID NO: 2877) | TTACCCGCACAG (SEQ ID NO: 2878) | |
| GAGTACAGTCTA (SEQ ID NO: 2879) | ACCGTCTTTCTC (SEQ ID NO: 2880) | ACCTGATCCGCA (SEQ ID NO: 2881) | GGTTGAGAAGAG (SEQ ID NO: 2882) | CCTGTTAGCGAA (SEQ ID NO: 2883) | |
| CCTACATGAGAC (SEQ ID NO: 2884) | AGTCTGTCTGCG (SEQ ID NO: 2885) | CAAGCTAGCTGT (SEQ ID NO: 2886) | CTGGGAGTTGTT (SEQ ID NO: 2887) | GCTCCGACCATA (SEQ ID NO: 2888) | |
| TCCGTGGTATAG (SEQ ID NO: 2889) | CCGCACTCAAGT (SEQ ID NO: 2890) | GTGGATAAACTC (SEQ ID NO: 2891) | ATCATCTCGGCG (SEQ ID NO: 2892) | ACAAATCGTTGG (SEQ ID NO: 2893) | |
| TCTACGGCACGT (SEQ ID NO: 2894) | TGTGGAAACTCC (SEQ ID NO: 2895) | GGTACAATGATC (SEQ ID NO: 2896) | ATTACCCACAGG (SEQ ID NO: 2897) | GAAGGAAAGTAG (SEQ ID NO: 2898) | |
| ATGCTGCAACAC (SEQ ID NO: 2899) | TTAGGCAGGTTC (SEQ ID NO: 2900) | ACTGTCGCAGTA (SEQ ID NO: 2901) | CACATCAGCGCT (SEQ ID NO: 2902) | ACAAACATGGTC (SEQ ID NO: 2903) | |
| TTCTCATGGAGG (SEQ ID NO: 2904) | TAAGACTACTGG (SEQ ID NO: 2905) | CATCCTGAGCAA (SEQ ID NO: 2906) | TGACCATAGTGA (SEQ ID NO: 2907) | GGACTATCGTTG (SEQ ID NO: 2908) | |
| CATAGTGATTGG (SEQ ID NO: 2909) | CGCGAAGTTTCA (SEQ ID NO: 2910) | CAACATCGTAGC (SEQ ID NO: 2911) | GATAAGCGCCTT (SEQ ID NO: 2912) | GCTATATCCAGG (SEQ ID NO: 2913) | |

TABLE 1-continued (SEQ ID NOS 775-2938, respectively, in order
of appearance from left to right in each row as shown)

| Barcode Sequence Fragments | Barcode Sequence Fragments | Barcode Sequence Fragments | Barcode Sequence Fragments | Barcode Sequence Fragments | Barcode Sequence Fragments |
|---|---|---|---|---|---|
| GCTATCAAGACA (SEQ ID NO: 2914) | CGATACACTGCC (SEQ ID NO: 2915) | GGCAATCATCTG (SEQ ID NO: 2916) | TAGTCTAAGGGT (SEQ ID NO: 2917) | TATTCCCACGTT (SEQ ID NO: 2918) | |
| CCGTGACAACTC (SEQ ID NO: 2919) | TTGAAATCCCGG (SEQ ID NO: 2920) | TATCGCGCGATA (SEQ ID NO: 2921) | AATTAGGCGTGT (SEQ ID NO: 2922) | CCATTAGTTCCT (SEQ ID NO: 2923) | |
| CGTTCCTTGTTA (SEQ ID NO: 2924) | GTTAGGGAGCGA (SEQ ID NO: 2925) | TACGGTCTGGAT (SEQ ID NO: 2926) | TGCTCTTGCTCT (SEQ ID NO: 2927) | TAACCTTCGCTT (SEQ ID NO: 2928) | |
| GGAATTATCGGT (SEQ ID NO: 2929) | TTACTGTGGCCG (SEQ ID NO: 2930) | TCGTTCAGGACC (SEQ ID NO: 2931) | TCCACTAGAGCA (SEQ ID NO: 2932) | GTAATCTGCCGA (SEQ ID NO: 2933) | |
| CATCAAGCATAG (SEQ ID NO: 2934) | ATATAAGGCCCA (SEQ ID NO: 2935) | TGATCCGGGTAT (SEQ ID NO: 2936) | CATTGCAAAGCA (SEQ ID NO: 2937) | GGTGGCATGGAA (SEQ ID NO: 2938) | |

TABLE 2

| | forward primer binding site fragment | 5' universal sequence fragment | barcode sequence fragment | 3' universal sequence fragment | reverse primer binding site fragment |
|---|---|---|---|---|---|
| (SEQ ID NO: 1) | CCTACGGGAGGCATCAG | GCAGATCTCG | CCTACGGGAGGCATCAG | AGTCAGTCAGCC | GGATTAGATACCCTAGTAGTC |
| (SEQ ID NO: 2) | CCTACGGGAGGCATCAG | GCAGATCTCG | CCTACGGGAGGCATCAG | AGTCAGTCAGCC | GGATTAGATACCCTAGTAGTC |
| (SEQ ID NO: 3) | CCTACGGGAGGCATCAG | GCAGATCTCG | CCTACGGGAGGCATCAG | AGTCAGTCAGCC | GGATTAGATACCCTAGTAGTC |
| (SEQ ID NO: 4) | CCTACGGGAGGCATCAG | GCAGATCTCG | CCTACGGGAGGCATCAG | AGTCAGTCAGCC | GGATTAGATACCCTAGTAGTC |
| (SEQ ID NO: 5) | CCTACGGGAGGCATCAG | GCAGATCTCG | CCTACGGGAGGCATCAG | AGTCAGTCAGCC | GGATTAGATACCCTAGTAGTC |
| (SEQ ID NO: 6) | CCTACGGGAGGCATCAG | GCAGATCTCG | CCTACGGGAGGCATCAG | AGTCAGTCAGCC | GGATTAGATACCCTAGTAGTC |
| (SEQ ID NO: 7) | CCTACGGGAGGCATCAG | GCAGATCTCG | CCTACGGGAGGCATCAG | AGTCAGTCAGCC | GGATTAGATACCCTAGTAGTC |
| (SEQ ID NO: 8) | CCTACGGGAGGCATCAG | GCAGATCTCG | CCTACGGGAGGCATCAG | AGTCAGTCAGCC | GGATTAGATACCCTAGTAGTC |
| (SEQ ID NO: 9) | CCTACGGGAGGCATCAG | GCAGATCTCG | CCTACGGGAGGCATCAG | AGTCAGTCAGCC | GGATTAGATACCCTAGTAGTC |
| (SEQ ID NO: 10) | CCTACGGGAGGCATCAG | GCAGATCTCG | CCTACGGGAGGCATCAG | AGTCAGTCAGCC | GGATTAGATACCCTAGTAGTC |
| (SEQ ID NO: 11) | CCTACGGGAGGCATCAG | GCAGATCTCG | CCTACGGGAGGCATCAG | AGTCAGTCAGCC | GGATTAGATACCCTAGTAGTC |
| (SEQ ID NO: 12) | CCTACGGGAGGCATCAG | GCAGATCTCG | CCTACGGGAGGCATCAG | AGTCAGTCAGCC | GGATTAGATACCCTAGTAGTC |
| (SEQ ID NO: 13) | CCTACGGGAGGCATCAG | GCAGATCTCG | CCTACGGGAGGCATCAG | AGTCAGTCAGCC | GGATTAGATACCCTAGTAGTC |
| (SEQ ID NO: 14) | CCTACGGGAGGCATCAG | GCAGATCTCG | CCTACGGGAGGCATCAG | AGTCAGTCAGCC | GGATTAGATACCCTAGTAGTC |
| (SEQ ID NO: 15) | CCTACGGGAGGCATCAG | GCAGATCTCG | CCTACGGGAGGCATCAG | AGTCAGTCAGCC | GGATTAGATACCCTAGTAGTC |
| (SEQ ID NO: 16) | CCTACGGGAGGCATCAG | GCAGATCTCG | CCTACGGGAGGCATCAG | AGTCAGTCAGCC | GGATTAGATACCCTAGTAGTC |
| (SEQ ID NO: 17) | CCTACGGGAGGCATCAG | GCAGATCTCG | CCTACGGGAGGCATCAG | AGTCAGTCAGCC | GGATTAGATACCCTAGTAGTC |
| (SEQ ID NO: 18) | CCTACGGGAGGCATCAG | GCAGATCTCG | CCTACGGGAGGCATCAG | AGTCAGTCAGCC | GGATTAGATACCCTAGTAGTC |
| (SEQ ID NO: 19) | CCTACGGGAGGCATCAG | GCAGATCTCG | CCTACGGGAGGCATCAG | AGTCAGTCAGCC | GGATTAGATACCCTAGTAGTC |
| (SEQ ID NO: 20) | CCTACGGGAGGCATCAG | GCAGATCTCG | CCTACGGGAGGCATCAG | AGTCAGTCAGCC | GGATTAGATACCCTAGTAGTC |
| (SEQ ID NO: 21) | CCTACGGGAGGCATCAG | GCAGATCTCG | CCTACGGGAGGCATCAG | AGTCAGTCAGCC | GGATTAGATACCCTAGTAGTC |
| (SEQ ID NO: 22) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 23) | CCTACGGGAGGCATCAG | GCAGATCTCG | CCTACGGGAGGCATCAG | AGTCAGTCAGCC | GGATTAGATACCCTAGTAGTC |
| (SEQ ID NO: 24) | CCTACGGGAGGCATCAG | GCAGATCTCG | CCTACGGGAGGCATCAG | AGTCAGTCAGCC | GGATTAGATACCCTAGTAGTC |
| (SEQ ID NO: 25) | CCTACGGGAGGCATCAG | GCAGATCTCG | CCTACGGGAGGCATCAG | AGTCAGTCAGCC | GGATTAGATACCCTAGTAGTC |
| (SEQ ID NO: 26) | CCTACGGGAGGCATCAG | GCAGATCTCG | CCTACGGGAGGCATCAG | AGTCAGTCAGCC | GGATTAGATACCCTAGTAGTC |
| (SEQ ID NO: 27) | CCTACGGGAGGCATCAG | GCAGATCTCG | CCTACGGGAGGCATCAG | AGTCAGTCAGCC | GGATTAGATACCCTAGTAGTC |
| (SEQ ID NO: 28) | CCTACGGGAGGCATCAG | GCAGATCTCG | CCTACGGGAGGCATCAG | AGTCAGTCAGCC | GGATTAGATACCCTAGTAGTC |
| (SEQ ID NO: 29) | CCTACGGGAGGCATCAG | GCAGATCTCG | CCTACGGGAGGCATCAG | AGTCAGTCAGCC | GGATTAGATACCCTAGTAGTC |
| (SEQ ID NO: 30) | CCTACGGGAGGCATCAG | GCAGATCTCG | CCTACGGGAGGCATCAG | AGTCAGTCAGCC | GGATTAGATACCCTAGTAGTC |
| (SEQ ID NO: 31) | CCTACGGGAGGCATCAG | GCAGATCTCG | CCTACGGGAGGCATCAG | AGTCAGTCAGCC | GGATTAGATACCCTAGTAGTC |
| (SEQ ID NO: 32) | CCTACGGGAGGCATCAG | GCAGATCTCG | CCTACGGGAGGCATCAG | AGTCAGTCAGCC | GGATTAGATACCCTAGTAGTC |
| (SEQ ID NO: 33) | CCTACGGGAGGCATCAG | GCAGATCTCG | CCTACGGGAGGCATCAG | AGTCAGTCAGCC | GGATTAGATACCCTAGTAGTC |
| (SEQ ID NO: 34) | CCTACGGGAGGCATCAG | GCAGATCTCG | CCTACGGGAGGCATCAG | AGTCAGTCAGCC | GGATTAGATACCCTAGTAGTC |
| (SEQ ID NO: 35) | CCTACGGGAGGCATCAG | GCAGATCTCG | CCTACGGGAGGCATCAG | AGTCAGTCAGCC | GGATTAGATACCCTAGTAGTC |
| (SEQ ID NO: 36) | CCTACGGGAGGCATCAG | GCAGATCTCG | CCTACGGGAGGCATCAG | AGTCAGTCAGCC | GGATTAGATACCCTAGTAGTC |
| (SEQ ID NO: 37) | CCTACGGGAGGCATCAG | GCAGATCTCG | CCTACGGGAGGCATCAG | AGTCAGTCAGCC | GGATTAGATACCCTAGTAGTC |
| (SEQ ID NO: 38) | CCTACGGGAGGCATCAG | GCAGATCTCG | CCTACGGGAGGCATCAG | AGTCAGTCAGCC | GGATTAGATACCCTAGTAGTC |
| (SEQ ID NO: 39) | CCTACGGGAGGCATCAG | GCAGATCTCG | CCTACGGGAGGCATCAG | AGTCAGTCAGCC | GGATTAGATACCCTAGTAGTC |
| (SEQ ID NO: 40) | CCTACGGGAGGCATCAG | GCAGATCTCG | CCTACGGGAGGCATCAG | AGTCAGTCAGCC | GGATTAGATACCCTAGTAGTC |
| (SEQ ID NO: 41) | CCTACGGGAGGCATCAG | GCAGATCTCG | CCTACGGGAGGCATCAG | AGTCAGTCAGCC | GGATTAGATACCCTAGTAGTC |
| (SEQ ID NO: 42) | CCTACGGGAGGCATCAG | GCAGATCTCG | CCTACGGGAGGCATCAG | AGTCAGTCAGCC | GGATTAGATACCCTAGTAGTC |
| (SEQ ID NO: 43) | CCTACGGGAGGCATCAG | GCAGATCTCG | CCTACGGGAGGCATCAG | AGTCAGTCAGCC | GGATTAGATACCCTAGTAGTC |
| (SEQ ID NO: 44) | CCTACGGGAGGCATCAG | GCAGATCTCG | CCTACGGGAGGCATCAG | AGTCAGTCAGCC | GGATTAGATACCCTAGTAGTC |
| (SEQ ID NO: 45) | CCTACGGGAGGCATCAG | GCAGATCTCG | CCTACGGGAGGCATCAG | AGTCAGTCAGCC | GGATTAGATACCCTAGTAGTC |
| (SEQ ID NO: 46) | CCTACGGGAGGCATCAG | GCAGATCTCG | CCTACGGGAGGCATCAG | AGTCAGTCAGCC | GGATTAGATACCCTAGTAGTC |
| (SEQ ID NO: 47) | CCTACGGGAGGCATCAG | GCAGATCTCG | CCTACGGGAGGCATCAG | AGTCAGTCAGCC | GGATTAGATACCCTAGTAGTC |
| (SEQ ID NO: 48) | CCTACGGGAGGCATCAG | GCAGATCTCG | CCTACGGGAGGCATCAG | AGTCAGTCAGCC | GGATTAGATACCCTAGTAGTC |
| (SEQ ID NO: 49) | CCTACGGGAGGCATCAG | GCAGATCTCG | CCTACGGGAGGCATCAG | AGTCAGTCAGCC | GGATTAGATACCCTAGTAGTC |
| (SEQ ID NO: 50) | CCTACGGGAGGCATCAG | GCAGATCTCG | CCTACGGGAGGCATCAG | AGTCAGTCAGCC | GGATTAGATACCCTAGTAGTC |
| (SEQ ID NO: 51) | CCTACGGGAGGCATCAG | GCAGATCTCG | CCTACGGGAGGCATCAG | AGTCAGTCAGCC | GGATTAGATACCCTAGTAGTC |
| (SEQ ID NO: 52) | CCTACGGGAGGCATCAG | GCAGATCTCG | CCTACGGGAGGCATCAG | AGTCAGTCAGCC | GGATTAGATACCCTAGTAGTC |
| (SEQ ID NO: 53) | CCTACGGGAGGCATCAG | GCAGATCTCG | CCTACGGGAGGCATCAG | AGTCAGTCAGCC | GGATTAGATACCCTAGTAGTC |
| (SEQ ID NO: 54) | CCTACGGGAGGCATCAG | GCAGATCTCG | CCTACGGGAGGCATCAG | AGTCAGTCAGCC | GGATTAGATACCCTAGTAGTC |
| (SEQ ID NO: 55) | CCTACGGGAGGCATCAG | GCAGATCTCG | CCTACGGGAGGCATCAG | AGTCAGTCAGCC | GGATTAGATACCCTAGTAGTC |
| (SEQ ID NO: 56) | CCTACGGGAGGCATCAG | GCAGATCTCG | CCTACGGGAGGCATCAG | AGTCAGTCAGCC | GGATTAGATACCCTAGTAGTC |
| (SEQ ID NO: 57) | CCTACGGGAGGCATCAG | GCAGATCTCG | CCTACGGGAGGCATCAG | AGTCAGTCAGCC | GGATTAGATACCCTAGTAGTC |
| (SEQ ID NO: 58) | CCTACGGGAGGCATCAG | GCAGATCTCG | CCTACGGGAGGCATCAG | AGTCAGTCAGCC | GGATTAGATACCCTAGTAGTC |
| (SEQ ID NO: 59) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 60) | CCTACGGGAGGCATCAG | GCAGATCTCG | CCTACGGGAGGCATCAG | AGTCAGTCAGCC | GGATTAGATACCCTAGTAGTC |
| (SEQ ID NO: 61) | CCTACGGGAGGCATCAG | GCAGATCTCG | CCTACGGGAGGCATCAG | AGTCAGTCAGCC | GGATTAGATACCCTAGTAGTC |
| (SEQ ID NO: 62) | CCTACGGGAGGCATCAG | GCAGATCTCG | CCTACGGGAGGCATCAG | AGTCAGTCAGCC | GGATTAGATACCCTAGTAGTC |
| (SEQ ID NO: 63) | CCTACGGGAGGCATCAG | GCAGATCTCG | CCTACGGGAGGCATCAG | AGTCAGTCAGCC | GGATTAGATACCCTAGTAGTC |
| (SEQ ID NO: 64) | CCTACGGGAGGCATCAG | GCAGATCTCG | CCTACGGGAGGCATCAG | AGTCAGTCAGCC | GGATTAGATACCCTAGTAGTC |
| (SEQ ID NO: 65) | CCTACGGGAGGCATCAG | GCAGATCTCG | CCTACGGGAGGCATCAG | AGTCAGTCAGCC | GGATTAGATACCCTAGTAGTC |
| (SEQ ID NO: 66) | CCTACGGGAGGCATCAG | GCAGATCTCG | CCTACGGGAGGCATCAG | AGTCAGTCAGCC | GGATTAGATACCCTAGTAGTC |
| (SEQ ID NO: 67) | CCTACGGGAGGCATCAG | GCAGATCTCG | CCTACGGGAGGCATCAG | AGTCAGTCAGCC | GGATTAGATACCCTAGTAGTC |
| (SEQ ID NO: 68) | CCTACGGGAGGCATCAG | GCAGATCTCG | CCTACGGGAGGCATCAG | AGTCAGTCAGCC | GGATTAGATACCCTAGTAGTC |
| (SEQ ID NO: 69) | CCTACGGGAGGCATCAG | GCAGATCTCG | CCTACGGGAGGCATCAG | AGTCAGTCAGCC | GGATTAGATACCCTAGTAGTC |
| (SEQ ID NO: 70) | CCTACGGGAGGCATCAG | GCAGATCTCG | CCTACGGGAGGCATCAG | AGTCAGTCAGCC | GGATTAGATACCCTAGTAGTC |
| (SEQ ID NO: 71) | CCTACGGGAGGCATCAG | GCAGATCTCG | CCTACGGGAGGCATCAG | AGTCAGTCAGCC | GGATTAGATACCCTAGTAGTC |
| (SEQ ID NO: 72) | CCTACGGGAGGCATCAG | GCAGATCTCG | CCTACGGGAGGCATCAG | AGTCAGTCAGCC | GGATTAGATACCCTAGTAGTC |
| (SEQ ID NO: 73) | CCTACGGGAGGCATCAG | GCAGATCTCG | CCTACGGGAGGCATCAG | AGTCAGTCAGCC | GGATTAGATACCCTAGTAGTC |
| (SEQ ID NO: 74) | CCTACGGGAGGCATCAG | GCAGATCTCG | CCTACGGGAGGCATCAG | AGTCAGTCAGCC | GGATTAGATACCCTAGTAGTC |
| (SEQ ID NO: 75) | CCTACGGGAGGCATCAG | GCAGATCTCG | CCTACGGGAGGCATCAG | AGTCAGTCAGCC | GGATTAGATACCCTAGTAGTC |
| (SEQ ID NO: 76) | CCTACGGGAGGCATCAG | GCAGATCTCG | CCTACGGGAGGCATCAG | AGTCAGTCAGCC | GGATTAGATACCCTAGTAGTC |
| (SEQ ID NO: 77) | CCTACGGGAGGCATCAG | GCAGATCTCG | CCTACGGGAGGCATCAG | AGTCAGTCAGCC | GGATTAGATACCCTAGTAGTC |
| (SEQ ID NO: 78) | CCTACGGGAGGCATCAG | GCAGATCTCG | CCTACGGGAGGCATCAG | AGTCAGTCAGCC | GGATTAGATACCCTAGTAGTC |
| (SEQ ID NO: 79) | CCTACGGGAGGCATCAG | GCAGATCTCG | CCTACGGGAGGCATCAG | AGTCAGTCAGCC | GGATTAGATACCCTAGTAGTC |
| (SEQ ID NO: 80) | CCTACGGGAGGCATCAG | GCAGATCTCG | CCTACGGGAGGCATCAG | AGTCAGTCAGCC | GGATTAGATACCCTAGTAGTC |
| (SEQ ID NO: 81) | CCTACGGGAGGCATCAG | GCAGATCTCG | CCTACGGGAGGCATCAG | AGTCAGTCAGCC | GGATTAGATACCCTAGTAGTC |
| (SEQ ID NO: 82) | CCTACGGGAGGCATCAG | GCAGATCTCG | CCTACGGGAGGCATCAG | AGTCAGTCAGCC | GGATTAGATACCCTAGTAGTC |
| (SEQ ID NO: 83) | CCTACGGGAGGCATCAG | GCAGATCTCG | CCTACGGGAGGCATCAG | AGTCAGTCAGCC | GGATTAGATACCCTAGTAGTC |
| (SEQ ID NO: 84) | CCTACGGGAGGCATCAG | GCAGATCTCG | CCTACGGGAGGCATCAG | AGTCAGTCAGCC | GGATTAGATACCCTAGTAGTC |
| (SEQ ID NO: 85) | CCTACGGGAGGCATCAG | GCAGATCTCG | CCTACGGGAGGCATCAG | AGTCAGTCAGCC | GGATTAGATACCCTAGTAGTC |
| (SEQ ID NO: 86) | CCTACGGGAGGCATCAG | GCAGATCTCG | CCTACGGGAGGCATCAG | AGTCAGTCAGCC | GGATTAGATACCCTAGTAGTC |
| (SEQ ID NO: 87) | CCTACGGGAGGCATCAG | GCAGATCTCG | CCTACGGGAGGCATCAG | AGTCAGTCAGCC | GGATTAGATACCCTAGTAGTC |
| (SEQ ID NO: 88) | CCTACGGGAGGCATCAG | GCAGATCTCG | CCTACGGGAGGCATCAG | AGTCAGTCAGCC | GGATTAGATACCCTAGTAGTC |
| (SEQ ID NO: 89) | CCTACGGGAGGCATCAG | GCAGATCTCG | CCTACGGGAGGCATCAG | AGTCAGTCAGCC | GGATTAGATACCCTAGTAGTC |
| (SEQ ID NO: 90) | CCTACGGGAGGCATCAG | GCAGATCTCG | CCTACGGGAGGCATCAG | AGTCAGTCAGCC | GGATTAGATACCCTAGTAGTC |
| (SEQ ID NO: 91) | CCTACGGGAGGCATCAG | GCAGATCTCG | CCTACGGGAGGCATCAG | AGTCAGTCAGCC | GGATTAGATACCCTAGTAGTC |
| (SEQ ID NO: 92) | CCTACGGGAGGCATCAG | GCAGATCTCG | CCTACGGGAGGCATCAG | AGTCAGTCAGCC | GGATTAGATACCCTAGTAGTC |
| (SEQ ID NO: 93) | CCTACGGGAGGCATCAG | GCAGATCTCG | CCTACGGGAGGCATCAG | AGTCAGTCAGCC | GGATTAGATACCCTAGTAGTC |
| (SEQ ID NO: 94) | CCTACGGGAGGCATCAG | GCAGATCTCG | CCTACGGGAGGCATCAG | AGTCAGTCAGCC | GGATTAGATACCCTAGTAGTC |
| (SEQ ID NO: 95) | CCTACGGGAGGCATCAG | GCAGATCTCG | CCTACGGGAGGCATCAG | AGTCAGTCAGCC | GGATTAGATACCCTAGTAGTC |
| (SEQ ID NO: 96) | CCTACGGGAGGCATCAG | GCAGATCTCG | CCTACGGGAGGCATCAG | AGTCAGTCAGCC | GGATTAGATACCCTAGTAGTC |
| (SEQ ID NO: 97) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 98) | CCTACGGGAGGCATCAG | GCAGATCTCG | CCTACGGGAGGCATCAG | AGTCAGTCAGCC | GGATTAGATACCCTAGTAGTC |
| (SEQ ID NO: 99) | CCTACGGGAGGCATCAG | GCAGATCTCG | CCTACGGGAGGCATCAG | AGTCAGTCAGCC | GGATTAGATACCCTAGTAGTC |
| (SEQ ID NO: 100) | CCTACGGGAGGCATCAG | GCAGATCTCG | CCTACGGGAGGCATCAG | AGTCAGTCAGCC | GGATTAGATACCCTAGTAGTC |
| (SEQ ID NO: 101) | CCTACGGGAGGCATCAG | GCAGATCTCG | CCTACGGGAGGCATCAG | AGTCAGTCAGCC | GGATTAGATACCCTAGTAGTC |
| (SEQ ID NO: 102) | CCTACGGGAGGCATCAG | GCAGATCTCG | CCTACGGGAGGCATCAG | AGTCAGTCAGCC | GGATTAGATACCCTAGTAGTC |
| (SEQ ID NO: 103) | CCTACGGGAGGCATCAG | GCAGATCTCG | CCTACGGGAGGCATCAG | AGTCAGTCAGCC | GGATTAGATACCCTAGTAGTC |
| (SEQ ID NO: 104) | CCTACGGGAGGCATCAG | GCAGATCTCG | CCTACGGGAGGCATCAG | AGTCAGTCAGCC | GGATTAGATACCCTAGTAGTC |
| (SEQ ID NO: 105) | CCTACGGGAGGCATCAG | GCAGATCTCG | CCTACGGGAGGCATCAG | AGTCAGTCAGCC | GGATTAGATACCCTAGTAGTC |
| (SEQ ID NO: 106) | CCTACGGGAGGCATCAG | GCAGATCTCG | CCTACGGGAGGCATCAG | AGTCAGTCAGCC | GGATTAGATACCCTAGTAGTC |
| (SEQ ID NO: 107) | CCTACGGGAGGCATCAG | GCAGATCTCG | CCTACGGGAGGCATCAG | AGTCAGTCAGCC | GGATTAGATACCCTAGTAGTC |
| (SEQ ID NO: 108) | CCTACGGGAGGCATCAG | GCAGATCTCG | CCTACGGGAGGCATCAG | AGTCAGTCAGCC | GGATTAGATACCCTAGTAGTC |
| (SEQ ID NO: 109) | CCTACGGGAGGCATCAG | GCAGATCTCG | CCTACGGGAGGCATCAG | AGTCAGTCAGCC | GGATTAGATACCCTAGTAGTC |
| (SEQ ID NO: 110) | CCTACGGGAGGCATCAG | GCAGATCTCG | CCTACGGGAGGCATCAG | AGTCAGTCAGCC | GGATTAGATACCCTAGTAGTC |
| (SEQ ID NO: 111) | CCTACGGGAGGCATCAG | GCAGATCTCG | CCTACGGGAGGCATCAG | AGTCAGTCAGCC | GGATTAGATACCCTAGTAGTC |
| (SEQ ID NO: 112) | CCTACGGGAGGCATCAG | GCAGATCTCG | CCTACGGGAGGCATCAG | AGTCAGTCAGCC | GGATTAGATACCCTAGTAGTC |
| (SEQ ID NO: 113) | CCTACGGGAGGCATCAG | GCAGATCTCG | CCTACGGGAGGCATCAG | AGTCAGTCAGCC | GGATTAGATACCCTAGTAGTC |
| (SEQ ID NO: 114) | CCTACGGGAGGCATCAG | GCAGATCTCG | CCTACGGGAGGCATCAG | AGTCAGTCAGCC | GGATTAGATACCCTAGTAGTC |
| (SEQ ID NO: 115) | CCTACGGGAGGCATCAG | GCAGATCTCG | CCTACGGGAGGCATCAG | AGTCAGTCAGCC | GGATTAGATACCCTAGTAGTC |
| (SEQ ID NO: 116) | CCTACGGGAGGCATCAG | GCAGATCTCG | CCTACGGGAGGCATCAG | AGTCAGTCAGCC | GGATTAGATACCCTAGTAGTC |
| (SEQ ID NO: 117) | CCTACGGGAGGCATCAG | GCAGATCTCG | CCTACGGGAGGCATCAG | AGTCAGTCAGCC | GGATTAGATACCCTAGTAGTC |
| (SEQ ID NO: 118) | CCTACGGGAGGCATCAG | GCAGATCTCG | CCTACGGGAGGCATCAG | AGTCAGTCAGCC | GGATTAGATACCCTAGTAGTC |
| (SEQ ID NO: 119) | CCTACGGGAGGCATCAG | GCAGATCTCG | CCTACGGGAGGCATCAG | AGTCAGTCAGCC | GGATTAGATACCCTAGTAGTC |
| (SEQ ID NO: 120) | CCTACGGGAGGCATCAG | GCAGATCTCG | CCTACGGGAGGCATCAG | AGTCAGTCAGCC | GGATTAGATACCCTAGTAGTC |
| (SEQ ID NO: 121) | CCTACGGGAGGCATCAG | GCAGATCTCG | CCTACGGGAGGCATCAG | AGTCAGTCAGCC | GGATTAGATACCCTAGTAGTC |
| (SEQ ID NO: 122) | CCTACGGGAGGCATCAG | GCAGATCTCG | CCTACGGGAGGCATCAG | AGTCAGTCAGCC | GGATTAGATACCCTAGTAGTC |
| (SEQ ID NO: 123) | CCTACGGGAGGCATCAG | GCAGATCTCG | CCTACGGGAGGCATCAG | AGTCAGTCAGCC | GGATTAGATACCCTAGTAGTC |
| (SEQ ID NO: 124) | CCTACGGGAGGCATCAG | GCAGATCTCG | CCTACGGGAGGCATCAG | AGTCAGTCAGCC | GGATTAGATACCCTAGTAGTC |
| (SEQ ID NO: 125) | CCTACGGGAGGCATCAG | GCAGATCTCG | CCTACGGGAGGCATCAG | AGTCAGTCAGCC | GGATTAGATACCCTAGTAGTC |
| (SEQ ID NO: 126) | CCTACGGGAGGCATCAG | GCAGATCTCG | CCTACGGGAGGCATCAG | AGTCAGTCAGCC | GGATTAGATACCCTAGTAGTC |
| (SEQ ID NO: 127) | CCTACGGGAGGCATCAG | GCAGATCTCG | CCTACGGGAGGCATCAG | AGTCAGTCAGCC | GGATTAGATACCCTAGTAGTC |
| (SEQ ID NO: 128) | CCTACGGGAGGCATCAG | GCAGATCTCG | CCTACGGGAGGCATCAG | AGTCAGTCAGCC | GGATTAGATACCCTAGTAGTC |
| (SEQ ID NO: 129) | CCTACGGGAGGCATCAG | GCAGATCTCG | CCTACGGGAGGCATCAG | AGTCAGTCAGCC | GGATTAGATACCCTAGTAGTC |
| (SEQ ID NO: 130) | CCTACGGGAGGCATCAG | GCAGATCTCG | CCTACGGGAGGCATCAG | AGTCAGTCAGCC | GGATTAGATACCCTAGTAGTC |
| (SEQ ID NO: 131) | CCTACGGGAGGCATCAG | GCAGATCTCG | CCTACGGGAGGCATCAG | AGTCAGTCAGCC | GGATTAGATACCCTAGTAGTC |
| (SEQ ID NO: 132) | CCTACGGGAGGCATCAG | GCAGATCTCG | CCTACGGGAGGCATCAG | AGTCAGTCAGCC | GGATTAGATACCCTAGTAGTC |
| (SEQ ID NO: 133) | CCTACGGGAGGCATCAG | GCAGATCTCG | CCTACGGGAGGCATCAG | AGTCAGTCAGCC | GGATTAGATACCCTAGTAGTC |
| (SEQ ID NO: 134) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 135) | CCTACGGGAGGCATCAG | GCAGATCTCG | CCTACGGGAGGCATCAG | AGTCAGTCAGCC | GGATTAGATACCCTAGTAGTC |
| (SEQ ID NO: 136) | CCTACGGGAGGCATCAG | GCAGATCTCG | CCTACGGGAGGCATCAG | AGTCAGTCAGCC | GGATTAGATACCCTAGTAGTC |
| (SEQ ID NO: 137) | CCTACGGGAGGCATCAG | GCAGATCTCG | CCTACGGGAGGCATCAG | AGTCAGTCAGCC | GGATTAGATACCCTAGTAGTC |
| (SEQ ID NO: 138) | CCTACGGGAGGCATCAG | GCAGATCTCG | CCTACGGGAGGCATCAG | AGTCAGTCAGCC | GGATTAGATACCCTAGTAGTC |
| (SEQ ID NO: 139) | CCTACGGGAGGCATCAG | GCAGATCTCG | CCTACGGGAGGCATCAG | AGTCAGTCAGCC | GGATTAGATACCCTAGTAGTC |
| (SEQ ID NO: 140) | CCTACGGGAGGCATCAG | GCAGATCTCG | CCTACGGGAGGCATCAG | AGTCAGTCAGCC | GGATTAGATACCCTAGTAGTC |
| (SEQ ID NO: 141) | CCTACGGGAGGCATCAG | GCAGATCTCG | CCTACGGGAGGCATCAG | AGTCAGTCAGCC | GGATTAGATACCCTAGTAGTC |
| (SEQ ID NO: 142) | CCTACGGGAGGCATCAG | GCAGATCTCG | CCTACGGGAGGCATCAG | AGTCAGTCAGCC | GGATTAGATACCCTAGTAGTC |
| (SEQ ID NO: 143) | CCTACGGGAGGCATCAG | GCAGATCTCG | CCTACGGGAGGCATCAG | AGTCAGTCAGCC | GGATTAGATACCCTAGTAGTC |
| (SEQ ID NO: 144) | CCTACGGGAGGCATCAG | GCAGATCTCG | CCTACGGGAGGCATCAG | AGTCAGTCAGCC | GGATTAGATACCCTAGTAGTC |
| (SEQ ID NO: 145) | CCTACGGGAGGCATCAG | GCAGATCTCG | CCTACGGGAGGCATCAG | AGTCAGTCAGCC | GGATTAGATACCCTAGTAGTC |
| (SEQ ID NO: 146) | CCTACGGGAGGCATCAG | GCAGATCTCG | CCTACGGGAGGCATCAG | AGTCAGTCAGCC | GGATTAGATACCCTAGTAGTC |
| (SEQ ID NO: 147) | CCTACGGGAGGCATCAG | GCAGATCTCG | CCTACGGGAGGCATCAG | AGTCAGTCAGCC | GGATTAGATACCCTAGTAGTC |
| (SEQ ID NO: 148) | CCTACGGGAGGCATCAG | GCAGATCTCG | CCTACGGGAGGCATCAG | AGTCAGTCAGCC | GGATTAGATACCCTAGTAGTC |
| (SEQ ID NO: 149) | CCTACGGGAGGCATCAG | GCAGATCTCG | CCTACGGGAGGCATCAG | AGTCAGTCAGCC | GGATTAGATACCCTAGTAGTC |
| (SEQ ID NO: 150) | CCTACGGGAGGCATCAG | GCAGATCTCG | CCTACGGGAGGCATCAG | AGTCAGTCAGCC | GGATTAGATACCCTAGTAGTC |
| (SEQ ID NO: 151) | CCTACGGGAGGCATCAG | GCAGATCTCG | CCTACGGGAGGCATCAG | AGTCAGTCAGCC | GGATTAGATACCCTAGTAGTC |
| (SEQ ID NO: 152) | CCTACGGGAGGCATCAG | GCAGATCTCG | CCTACGGGAGGCATCAG | AGTCAGTCAGCC | GGATTAGATACCCTAGTAGTC |
| (SEQ ID NO: 153) | CCTACGGGAGGCATCAG | GCAGATCTCG | CCTACGGGAGGCATCAG | AGTCAGTCAGCC | GGATTAGATACCCTAGTAGTC |
| (SEQ ID NO: 154) | CCTACGGGAGGCATCAG | GCAGATCTCG | CCTACGGGAGGCATCAG | AGTCAGTCAGCC | GGATTAGATACCCTAGTAGTC |
| (SEQ ID NO: 155) | CCTACGGGAGGCATCAG | GCAGATCTCG | CCTACGGGAGGCATCAG | AGTCAGTCAGCC | GGATTAGATACCCTAGTAGTC |
| (SEQ ID NO: 156) | CCTACGGGAGGCATCAG | GCAGATCTCG | CCTACGGGAGGCATCAG | AGTCAGTCAGCC | GGATTAGATACCCTAGTAGTC |
| (SEQ ID NO: 157) | CCTACGGGAGGCATCAG | GCAGATCTCG | CCTACGGGAGGCATCAG | AGTCAGTCAGCC | GGATTAGATACCCTAGTAGTC |
| (SEQ ID NO: 158) | CCTACGGGAGGCATCAG | GCAGATCTCG | CCTACGGGAGGCATCAG | AGTCAGTCAGCC | GGATTAGATACCCTAGTAGTC |
| (SEQ ID NO: 159) | CCTACGGGAGGCATCAG | GCAGATCTCG | CCTACGGGAGGCATCAG | AGTCAGTCAGCC | GGATTAGATACCCTAGTAGTC |
| (SEQ ID NO: 160) | CCTACGGGAGGCATCAG | GCAGATCTCG | CCTACGGGAGGCATCAG | AGTCAGTCAGCC | GGATTAGATACCCTAGTAGTC |
| (SEQ ID NO: 161) | CCTACGGGAGGCATCAG | GCAGATCTCG | CCTACGGGAGGCATCAG | AGTCAGTCAGCC | GGATTAGATACCCTAGTAGTC |
| (SEQ ID NO: 162) | CCTACGGGAGGCATCAG | GCAGATCTCG | CCTACGGGAGGCATCAG | AGTCAGTCAGCC | GGATTAGATACCCTAGTAGTC |
| (SEQ ID NO: 163) | CCTACGGGAGGCATCAG | GCAGATCTCG | CCTACGGGAGGCATCAG | AGTCAGTCAGCC | GGATTAGATACCCTAGTAGTC |
| (SEQ ID NO: 164) | CCTACGGGAGGCATCAG | GCAGATCTCG | CCTACGGGAGGCATCAG | AGTCAGTCAGCC | GGATTAGATACCCTAGTAGTC |
| (SEQ ID NO: 165) | CCTACGGGAGGCATCAG | GCAGATCTCG | CCTACGGGAGGCATCAG | AGTCAGTCAGCC | GGATTAGATACCCTAGTAGTC |
| (SEQ ID NO: 166) | CCTACGGGAGGCATCAG | GCAGATCTCG | CCTACGGGAGGCATCAG | AGTCAGTCAGCC | GGATTAGATACCCTAGTAGTC |
| (SEQ ID NO: 167) | CCTACGGGAGGCATCAG | GCAGATCTCG | CCTACGGGAGGCATCAG | AGTCAGTCAGCC | GGATTAGATACCCTAGTAGTC |
| (SEQ ID NO: 168) | CCTACGGGAGGCATCAG | GCAGATCTCG | CCTACGGGAGGCATCAG | AGTCAGTCAGCC | GGATTAGATACCCTAGTAGTC |
| (SEQ ID NO: 169) | CCTACGGGAGGCATCAG | GCAGATCTCG | CCTACGGGAGGCATCAG | AGTCAGTCAGCC | GGATTAGATACCCTAGTAGTC |
| (SEQ ID NO: 170) | CCTACGGGAGGCATCAG | GCAGATCTCG | CCTACGGGAGGCATCAG | AGTCAGTCAGCC | GGATTAGATACCCTAGTAGTC |
| (SEQ ID NO: 171) | CCTACGGGAGGCATCAG | GCAGATCTCG | CCTACGGGAGGCATCAG | AGTCAGTCAGCC | GGATTAGATACCCTAGTAGTC |
| (SEQ ID NO: 172) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 173) | CCTACGGGAGGCATCAG | GCAGATCTCG | CCTACGGGAGGCATCAG | AGTCAGTCAGCC | GGATTAGATACCCTAGTAGTC |
| (SEQ ID NO: 174) | CCTACGGGAGGCATCAG | GCAGATCTCG | CCTACGGGAGGCATCAG | AGTCAGTCAGCC | GGATTAGATACCCTAGTAGTC |
| (SEQ ID NO: 175) | CCTACGGGAGGCATCAG | GCAGATCTCG | CCTACGGGAGGCATCAG | AGTCAGTCAGCC | GGATTAGATACCCTAGTAGTC |
| (SEQ ID NO: 176) | CCTACGGGAGGCATCAG | GCAGATCTCG | CCTACGGGAGGCATCAG | AGTCAGTCAGCC | GGATTAGATACCCTAGTAGTC |
| (SEQ ID NO: 177) | CCTACGGGAGGCATCAG | GCAGATCTCG | CCTACGGGAGGCATCAG | AGTCAGTCAGCC | GGATTAGATACCCTAGTAGTC |
| (SEQ ID NO: 178) | CCTACGGGAGGCATCAG | GCAGATCTCG | CCTACGGGAGGCATCAG | AGTCAGTCAGCC | GGATTAGATACCCTAGTAGTC |
| (SEQ ID NO: 179) | CCTACGGGAGGCATCAG | GCAGATCTCG | CCTACGGGAGGCATCAG | AGTCAGTCAGCC | GGATTAGATACCCTAGTAGTC |
| (SEQ ID NO: 180) | CCTACGGGAGGCATCAG | GCAGATCTCG | CCTACGGGAGGCATCAG | AGTCAGTCAGCC | GGATTAGATACCCTAGTAGTC |
| (SEQ ID NO: 181) | CCTACGGGAGGCATCAG | GCAGATCTCG | CCTACGGGAGGCATCAG | AGTCAGTCAGCC | GGATTAGATACCCTAGTAGTC |
| (SEQ ID NO: 182) | CCTACGGGAGGCATCAG | GCAGATCTCG | CCTACGGGAGGCATCAG | AGTCAGTCAGCC | GGATTAGATACCCTAGTAGTC |
| (SEQ ID NO: 183) | CCTACGGGAGGCATCAG | GCAGATCTCG | CCTACGGGAGGCATCAG | AGTCAGTCAGCC | GGATTAGATACCCTAGTAGTC |
| (SEQ ID NO: 184) | CCTACGGGAGGCATCAG | GCAGATCTCG | CCTACGGGAGGCATCAG | AGTCAGTCAGCC | GGATTAGATACCCTAGTAGTC |
| (SEQ ID NO: 185) | CCTACGGGAGGCATCAG | GCAGATCTCG | CCTACGGGAGGCATCAG | AGTCAGTCAGCC | GGATTAGATACCCTAGTAGTC |
| (SEQ ID NO: 186) | CCTACGGGAGGCATCAG | GCAGATCTCG | CCTACGGGAGGCATCAG | AGTCAGTCAGCC | GGATTAGATACCCTAGTAGTC |
| (SEQ ID NO: 187) | CCTACGGGAGGCATCAG | GCAGATCTCG | CCTACGGGAGGCATCAG | AGTCAGTCAGCC | GGATTAGATACCCTAGTAGTC |
| (SEQ ID NO: 188) | CCTACGGGAGGCATCAG | GCAGATCTCG | CCTACGGGAGGCATCAG | AGTCAGTCAGCC | GGATTAGATACCCTAGTAGTC |
| (SEQ ID NO: 189) | CCTACGGGAGGCATCAG | GCAGATCTCG | CCTACGGGAGGCATCAG | AGTCAGTCAGCC | GGATTAGATACCCTAGTAGTC |
| (SEQ ID NO: 190) | CCTACGGGAGGCATCAG | GCAGATCTCG | CCTACGGGAGGCATCAG | AGTCAGTCAGCC | GGATTAGATACCCTAGTAGTC |
| (SEQ ID NO: 191) | CCTACGGGAGGCATCAG | GCAGATCTCG | CCTACGGGAGGCATCAG | AGTCAGTCAGCC | GGATTAGATACCCTAGTAGTC |
| (SEQ ID NO: 192) | CCTACGGGAGGCATCAG | GCAGATCTCG | CCTACGGGAGGCATCAG | AGTCAGTCAGCC | GGATTAGATACCCTAGTAGTC |
| (SEQ ID NO: 193) | CCTACGGGAGGCATCAG | GCAGATCTCG | CCTACGGGAGGCATCAG | AGTCAGTCAGCC | GGATTAGATACCCTAGTAGTC |
| (SEQ ID NO: 194) | CCTACGGGAGGCATCAG | GCAGATCTCG | CCTACGGGAGGCATCAG | AGTCAGTCAGCC | GGATTAGATACCCTAGTAGTC |
| (SEQ ID NO: 195) | CCTACGGGAGGCATCAG | GCAGATCTCG | CCTACGGGAGGCATCAG | AGTCAGTCAGCC | GGATTAGATACCCTAGTAGTC |
| (SEQ ID NO: 196) | CCTACGGGAGGCATCAG | GCAGATCTCG | CCTACGGGAGGCATCAG | AGTCAGTCAGCC | GGATTAGATACCCTAGTAGTC |
| (SEQ ID NO: 197) | CCTACGGGAGGCATCAG | GCAGATCTCG | CCTACGGGAGGCATCAG | AGTCAGTCAGCC | GGATTAGATACCCTAGTAGTC |
| (SEQ ID NO: 198) | CCTACGGGAGGCATCAG | GCAGATCTCG | CCTACGGGAGGCATCAG | AGTCAGTCAGCC | GGATTAGATACCCTAGTAGTC |
| (SEQ ID NO: 199) | CCTACGGGAGGCATCAG | GCAGATCTCG | CCTACGGGAGGCATCAG | AGTCAGTCAGCC | GGATTAGATACCCTAGTAGTC |
| (SEQ ID NO: 200) | CCTACGGGAGGCATCAG | GCAGATCTCG | CCTACGGGAGGCATCAG | AGTCAGTCAGCC | GGATTAGATACCCTAGTAGTC |
| (SEQ ID NO: 201) | CCTACGGGAGGCATCAG | GCAGATCTCG | CCTACGGGAGGCATCAG | AGTCAGTCAGCC | GGATTAGATACCCTAGTAGTC |
| (SEQ ID NO: 202) | CCTACGGGAGGCATCAG | GCAGATCTCG | CCTACGGGAGGCATCAG | AGTCAGTCAGCC | GGATTAGATACCCTAGTAGTC |
| (SEQ ID NO: 203) | CCTACGGGAGGCATCAG | GCAGATCTCG | CCTACGGGAGGCATCAG | AGTCAGTCAGCC | GGATTAGATACCCTAGTAGTC |
| (SEQ ID NO: 204) | CCTACGGGAGGCATCAG | GCAGATCTCG | CCTACGGGAGGCATCAG | AGTCAGTCAGCC | GGATTAGATACCCTAGTAGTC |
| (SEQ ID NO: 205) | CCTACGGGAGGCATCAG | GCAGATCTCG | CCTACGGGAGGCATCAG | AGTCAGTCAGCC | GGATTAGATACCCTAGTAGTC |
| (SEQ ID NO: 206) | CCTACGGGAGGCATCAG | GCAGATCTCG | CCTACGGGAGGCATCAG | AGTCAGTCAGCC | GGATTAGATACCCTAGTAGTC |
| (SEQ ID NO: 207) | CCTACGGGAGGCATCAG | GCAGATCTCG | CCTACGGGAGGCATCAG | AGTCAGTCAGCC | GGATTAGATACCCTAGTAGTC |
| (SEQ ID NO: 208) | CCTACGGGAGGCATCAG | GCAGATCTCG | CCTACGGGAGGCATCAG | AGTCAGTCAGCC | GGATTAGATACCCTAGTAGTC |
| (SEQ ID NO: 209) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 210) | CCTACGGGAGGCATCAG | GCAGATCTCG | CCTACGGGAGGCATCAG | AGTCAGTCAGCC | GGATTAGATACCCTAGTAGTC |
| (SEQ ID NO: 211) | CCTACGGGAGGCATCAG | GCAGATCTCG | CCTACGGGAGGCATCAG | AGTCAGTCAGCC | GGATTAGATACCCTAGTAGTC |
| (SEQ ID NO: 212) | CCTACGGGAGGCATCAG | GCAGATCTCG | CCTACGGGAGGCATCAG | AGTCAGTCAGCC | GGATTAGATACCCTAGTAGTC |
| (SEQ ID NO: 213) | CCTACGGGAGGCATCAG | GCAGATCTCG | CCTACGGGAGGCATCAG | AGTCAGTCAGCC | GGATTAGATACCCTAGTAGTC |
| (SEQ ID NO: 214) | CCTACGGGAGGCATCAG | GCAGATCTCG | CCTACGGGAGGCATCAG | AGTCAGTCAGCC | GGATTAGATACCCTAGTAGTC |
| (SEQ ID NO: 215) | CCTACGGGAGGCATCAG | GCAGATCTCG | CCTACGGGAGGCATCAG | AGTCAGTCAGCC | GGATTAGATACCCTAGTAGTC |
| (SEQ ID NO: 216) | CCTACGGGAGGCATCAG | GCAGATCTCG | CCTACGGGAGGCATCAG | AGTCAGTCAGCC | GGATTAGATACCCTAGTAGTC |
| (SEQ ID NO: 217) | CCTACGGGAGGCATCAG | GCAGATCTCG | CCTACGGGAGGCATCAG | AGTCAGTCAGCC | GGATTAGATACCCTAGTAGTC |
| (SEQ ID NO: 218) | CCTACGGGAGGCATCAG | GCAGATCTCG | CCTACGGGAGGCATCAG | AGTCAGTCAGCC | GGATTAGATACCCTAGTAGTC |
| (SEQ ID NO: 219) | CCTACGGGAGGCATCAG | GCAGATCTCG | CCTACGGGAGGCATCAG | AGTCAGTCAGCC | GGATTAGATACCCTAGTAGTC |
| (SEQ ID NO: 220) | CCTACGGGAGGCATCAG | GCAGATCTCG | CCTACGGGAGGCATCAG | AGTCAGTCAGCC | GGATTAGATACCCTAGTAGTC |
| (SEQ ID NO: 221) | CCTACGGGAGGCATCAG | GCAGATCTCG | CCTACGGGAGGCATCAG | AGTCAGTCAGCC | GGATTAGATACCCTAGTAGTC |
| (SEQ ID NO: 222) | CCTACGGGAGGCATCAG | GCAGATCTCG | CCTACGGGAGGCATCAG | AGTCAGTCAGCC | GGATTAGATACCCTAGTAGTC |
| (SEQ ID NO: 223) | CCTACGGGAGGCATCAG | GCAGATCTCG | CCTACGGGAGGCATCAG | AGTCAGTCAGCC | GGATTAGATACCCTAGTAGTC |
| (SEQ ID NO: 224) | CCTACGGGAGGCATCAG | GCAGATCTCG | CCTACGGGAGGCATCAG | AGTCAGTCAGCC | GGATTAGATACCCTAGTAGTC |
| (SEQ ID NO: 225) | CCTACGGGAGGCATCAG | GCAGATCTCG | CCTACGGGAGGCATCAG | AGTCAGTCAGCC | GGATTAGATACCCTAGTAGTC |
| (SEQ ID NO: 226) | CCTACGGGAGGCATCAG | GCAGATCTCG | CCTACGGGAGGCATCAG | AGTCAGTCAGCC | GGATTAGATACCCTAGTAGTC |
| (SEQ ID NO: 227) | CCTACGGGAGGCATCAG | GCAGATCTCG | CCTACGGGAGGCATCAG | AGTCAGTCAGCC | GGATTAGATACCCTAGTAGTC |
| (SEQ ID NO: 228) | CCTACGGGAGGCATCAG | GCAGATCTCG | CCTACGGGAGGCATCAG | AGTCAGTCAGCC | GGATTAGATACCCTAGTAGTC |
| (SEQ ID NO: 229) | CCTACGGGAGGCATCAG | GCAGATCTCG | CCTACGGGAGGCATCAG | AGTCAGTCAGCC | GGATTAGATACCCTAGTAGTC |
| (SEQ ID NO: 230) | CCTACGGGAGGCATCAG | GCAGATCTCG | CCTACGGGAGGCATCAG | AGTCAGTCAGCC | GGATTAGATACCCTAGTAGTC |
| (SEQ ID NO: 231) | CCTACGGGAGGCATCAG | GCAGATCTCG | CCTACGGGAGGCATCAG | AGTCAGTCAGCC | GGATTAGATACCCTAGTAGTC |
| (SEQ ID NO: 232) | CCTACGGGAGGCATCAG | GCAGATCTCG | CCTACGGGAGGCATCAG | AGTCAGTCAGCC | GGATTAGATACCCTAGTAGTC |
| (SEQ ID NO: 233) | CCTACGGGAGGCATCAG | GCAGATCTCG | CCTACGGGAGGCATCAG | AGTCAGTCAGCC | GGATTAGATACCCTAGTAGTC |
| (SEQ ID NO: 234) | CCTACGGGAGGCATCAG | GCAGATCTCG | CCTACGGGAGGCATCAG | AGTCAGTCAGCC | GGATTAGATACCCTAGTAGTC |
| (SEQ ID NO: 235) | CCTACGGGAGGCATCAG | GCAGATCTCG | CCTACGGGAGGCATCAG | AGTCAGTCAGCC | GGATTAGATACCCTAGTAGTC |
| (SEQ ID NO: 236) | CCTACGGGAGGCATCAG | GCAGATCTCG | CCTACGGGAGGCATCAG | AGTCAGTCAGCC | GGATTAGATACCCTAGTAGTC |
| (SEQ ID NO: 237) | CCTACGGGAGGCATCAG | GCAGATCTCG | CCTACGGGAGGCATCAG | AGTCAGTCAGCC | GGATTAGATACCCTAGTAGTC |
| (SEQ ID NO: 238) | CCTACGGGAGGCATCAG | GCAGATCTCG | CCTACGGGAGGCATCAG | AGTCAGTCAGCC | GGATTAGATACCCTAGTAGTC |
| (SEQ ID NO: 239) | CCTACGGGAGGCATCAG | GCAGATCTCG | CCTACGGGAGGCATCAG | AGTCAGTCAGCC | GGATTAGATACCCTAGTAGTC |
| (SEQ ID NO: 240) | CCTACGGGAGGCATCAG | GCAGATCTCG | CCTACGGGAGGCATCAG | AGTCAGTCAGCC | GGATTAGATACCCTAGTAGTC |
| (SEQ ID NO: 241) | CCTACGGGAGGCATCAG | GCAGATCTCG | CCTACGGGAGGCATCAG | AGTCAGTCAGCC | GGATTAGATACCCTAGTAGTC |
| (SEQ ID NO: 242) | CCTACGGGAGGCATCAG | GCAGATCTCG | CCTACGGGAGGCATCAG | AGTCAGTCAGCC | GGATTAGATACCCTAGTAGTC |
| (SEQ ID NO: 243) | CCTACGGGAGGCATCAG | GCAGATCTCG | CCTACGGGAGGCATCAG | AGTCAGTCAGCC | GGATTAGATACCCTAGTAGTC |
| (SEQ ID NO: 244) | CCTACGGGAGGCATCAG | GCAGATCTCG | CCTACGGGAGGCATCAG | AGTCAGTCAGCC | GGATTAGATACCCTAGTAGTC |
| (SEQ ID NO: 245) | CCTACGGGAGGCATCAG | GCAGATCTCG | CCTACGGGAGGCATCAG | AGTCAGTCAGCC | GGATTAGATACCCTAGTAGTC |
| (SEQ ID NO: 246) | CCTACGGGAGGCATCAG | GCAGATCTCG | CCTACGGGAGGCATCAG | AGTCAGTCAGCC | GGATTAGATACCCTAGTAGTC |
| (SEQ ID NO: 247) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 248) | CCTACGGGAGGCATCAG | GCAGATCTCG | CCTACGGGAGGCATCAG | AGTCAGTCAGCC | GGATTAGATACCCTAGTAGTC |
| (SEQ ID NO: 249) | CCTACGGGAGGCATCAG | GCAGATCTCG | CCTACGGGAGGCATCAG | AGTCAGTCAGCC | GGATTAGATACCCTAGTAGTC |
| (SEQ ID NO: 250) | CCTACGGGAGGCATCAG | GCAGATCTCG | CCTACGGGAGGCATCAG | AGTCAGTCAGCC | GGATTAGATACCCTAGTAGTC |
| (SEQ ID NO: 251) | CCTACGGGAGGCATCAG | GCAGATCTCG | CCTACGGGAGGCATCAG | AGTCAGTCAGCC | GGATTAGATACCCTAGTAGTC |
| (SEQ ID NO: 252) | CCTACGGGAGGCATCAG | GCAGATCTCG | CCTACGGGAGGCATCAG | AGTCAGTCAGCC | GGATTAGATACCCTAGTAGTC |
| (SEQ ID NO: 253) | CCTACGGGAGGCATCAG | GCAGATCTCG | CCTACGGGAGGCATCAG | AGTCAGTCAGCC | GGATTAGATACCCTAGTAGTC |
| (SEQ ID NO: 254) | CCTACGGGAGGCATCAG | GCAGATCTCG | CCTACGGGAGGCATCAG | AGTCAGTCAGCC | GGATTAGATACCCTAGTAGTC |
| (SEQ ID NO: 255) | CCTACGGGAGGCATCAG | GCAGATCTCG | CCTACGGGAGGCATCAG | AGTCAGTCAGCC | GGATTAGATACCCTAGTAGTC |
| (SEQ ID NO: 256) | CCTACGGGAGGCATCAG | GCAGATCTCG | CCTACGGGAGGCATCAG | AGTCAGTCAGCC | GGATTAGATACCCTAGTAGTC |
| (SEQ ID NO: 257) | CCTACGGGAGGCATCAG | GCAGATCTCG | CCTACGGGAGGCATCAG | AGTCAGTCAGCC | GGATTAGATACCCTAGTAGTC |
| (SEQ ID NO: 258) | CCTACGGGAGGCATCAG | GCAGATCTCG | CCTACGGGAGGCATCAG | AGTCAGTCAGCC | GGATTAGATACCCTAGTAGTC |
| (SEQ ID NO: 259) | CCTACGGGAGGCATCAG | GCAGATCTCG | CCTACGGGAGGCATCAG | AGTCAGTCAGCC | GGATTAGATACCCTAGTAGTC |
| (SEQ ID NO: 260) | CCTACGGGAGGCATCAG | GCAGATCTCG | CCTACGGGAGGCATCAG | AGTCAGTCAGCC | GGATTAGATACCCTAGTAGTC |
| (SEQ ID NO: 261) | CCTACGGGAGGCATCAG | GCAGATCTCG | CCTACGGGAGGCATCAG | AGTCAGTCAGCC | GGATTAGATACCCTAGTAGTC |
| (SEQ ID NO: 262) | CCTACGGGAGGCATCAG | GCAGATCTCG | CCTACGGGAGGCATCAG | AGTCAGTCAGCC | GGATTAGATACCCTAGTAGTC |
| (SEQ ID NO: 263) | CCTACGGGAGGCATCAG | GCAGATCTCG | CCTACGGGAGGCATCAG | AGTCAGTCAGCC | GGATTAGATACCCTAGTAGTC |
| (SEQ ID NO: 264) | CCTACGGGAGGCATCAG | GCAGATCTCG | CCTACGGGAGGCATCAG | AGTCAGTCAGCC | GGATTAGATACCCTAGTAGTC |
| (SEQ ID NO: 265) | CCTACGGGAGGCATCAG | GCAGATCTCG | CCTACGGGAGGCATCAG | AGTCAGTCAGCC | GGATTAGATACCCTAGTAGTC |
| (SEQ ID NO: 266) | CCTACGGGAGGCATCAG | GCAGATCTCG | CCTACGGGAGGCATCAG | AGTCAGTCAGCC | GGATTAGATACCCTAGTAGTC |
| (SEQ ID NO: 267) | CCTACGGGAGGCATCAG | GCAGATCTCG | CCTACGGGAGGCATCAG | AGTCAGTCAGCC | GGATTAGATACCCTAGTAGTC |
| (SEQ ID NO: 268) | CCTACGGGAGGCATCAG | GCAGATCTCG | CCTACGGGAGGCATCAG | AGTCAGTCAGCC | GGATTAGATACCCTAGTAGTC |
| (SEQ ID NO: 269) | CCTACGGGAGGCATCAG | GCAGATCTCG | CCTACGGGAGGCATCAG | AGTCAGTCAGCC | GGATTAGATACCCTAGTAGTC |
| (SEQ ID NO: 270) | CCTACGGGAGGCATCAG | GCAGATCTCG | CCTACGGGAGGCATCAG | AGTCAGTCAGCC | GGATTAGATACCCTAGTAGTC |
| (SEQ ID NO: 271) | CCTACGGGAGGCATCAG | GCAGATCTCG | CCTACGGGAGGCATCAG | AGTCAGTCAGCC | GGATTAGATACCCTAGTAGTC |
| (SEQ ID NO: 272) | CCTACGGGAGGCATCAG | GCAGATCTCG | CCTACGGGAGGCATCAG | AGTCAGTCAGCC | GGATTAGATACCCTAGTAGTC |
| (SEQ ID NO: 273) | CCTACGGGAGGCATCAG | GCAGATCTCG | CCTACGGGAGGCATCAG | AGTCAGTCAGCC | GGATTAGATACCCTAGTAGTC |
| (SEQ ID NO: 274) | CCTACGGGAGGCATCAG | GCAGATCTCG | CCTACGGGAGGCATCAG | AGTCAGTCAGCC | GGATTAGATACCCTAGTAGTC |
| (SEQ ID NO: 275) | CCTACGGGAGGCATCAG | GCAGATCTCG | CCTACGGGAGGCATCAG | AGTCAGTCAGCC | GGATTAGATACCCTAGTAGTC |
| (SEQ ID NO: 276) | CCTACGGGAGGCATCAG | GCAGATCTCG | CCTACGGGAGGCATCAG | AGTCAGTCAGCC | GGATTAGATACCCTAGTAGTC |
| (SEQ ID NO: 277) | CCTACGGGAGGCATCAG | GCAGATCTCG | CCTACGGGAGGCATCAG | AGTCAGTCAGCC | GGATTAGATACCCTAGTAGTC |
| (SEQ ID NO: 278) | CCTACGGGAGGCATCAG | GCAGATCTCG | CCTACGGGAGGCATCAG | AGTCAGTCAGCC | GGATTAGATACCCTAGTAGTC |
| (SEQ ID NO: 279) | CCTACGGGAGGCATCAG | GCAGATCTCG | CCTACGGGAGGCATCAG | AGTCAGTCAGCC | GGATTAGATACCCTAGTAGTC |
| (SEQ ID NO: 280) | CCTACGGGAGGCATCAG | GCAGATCTCG | CCTACGGGAGGCATCAG | AGTCAGTCAGCC | GGATTAGATACCCTAGTAGTC |
| (SEQ ID NO: 281) | CCTACGGGAGGCATCAG | GCAGATCTCG | CCTACGGGAGGCATCAG | AGTCAGTCAGCC | GGATTAGATACCCTAGTAGTC |
| (SEQ ID NO: 282) | CCTACGGGAGGCATCAG | GCAGATCTCG | CCTACGGGAGGCATCAG | AGTCAGTCAGCC | GGATTAGATACCCTAGTAGTC |
| (SEQ ID NO: 283) | CCTACGGGAGGCATCAG | GCAGATCTCG | CCTACGGGAGGCATCAG | AGTCAGTCAGCC | GGATTAGATACCCTAGTAGTC |
| (SEQ ID NO: 284) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 285) | CCTACGGGAGGCATCAG | GCAGATCTCG | CCTACGGGAGGCATCAG | AGTCAGTCAGCC | GGATTAGATACCCTAGTAGTC |
| (SEQ ID NO: 286) | CCTACGGGAGGCATCAG | GCAGATCTCG | CCTACGGGAGGCATCAG | AGTCAGTCAGCC | GGATTAGATACCCTAGTAGTC |
| (SEQ ID NO: 287) | CCTACGGGAGGCATCAG | GCAGATCTCG | CCTACGGGAGGCATCAG | AGTCAGTCAGCC | GGATTAGATACCCTAGTAGTC |
| (SEQ ID NO: 288) | CCTACGGGAGGCATCAG | GCAGATCTCG | CCTACGGGAGGCATCAG | AGTCAGTCAGCC | GGATTAGATACCCTAGTAGTC |
| (SEQ ID NO: 289) | CCTACGGGAGGCATCAG | GCAGATCTCG | CCTACGGGAGGCATCAG | AGTCAGTCAGCC | GGATTAGATACCCTAGTAGTC |
| (SEQ ID NO: 290) | CCTACGGGAGGCATCAG | GCAGATCTCG | CCTACGGGAGGCATCAG | AGTCAGTCAGCC | GGATTAGATACCCTAGTAGTC |
| (SEQ ID NO: 291) | CCTACGGGAGGCATCAG | GCAGATCTCG | CCTACGGGAGGCATCAG | AGTCAGTCAGCC | GGATTAGATACCCTAGTAGTC |
| (SEQ ID NO: 292) | CCTACGGGAGGCATCAG | GCAGATCTCG | CCTACGGGAGGCATCAG | AGTCAGTCAGCC | GGATTAGATACCCTAGTAGTC |
| (SEQ ID NO: 293) | CCTACGGGAGGCATCAG | GCAGATCTCG | CCTACGGGAGGCATCAG | AGTCAGTCAGCC | GGATTAGATACCCTAGTAGTC |
| (SEQ ID NO: 294) | CCTACGGGAGGCATCAG | GCAGATCTCG | CCTACGGGAGGCATCAG | AGTCAGTCAGCC | GGATTAGATACCCTAGTAGTC |
| (SEQ ID NO: 295) | CCTACGGGAGGCATCAG | GCAGATCTCG | CCTACGGGAGGCATCAG | AGTCAGTCAGCC | GGATTAGATACCCTAGTAGTC |
| (SEQ ID NO: 296) | CCTACGGGAGGCATCAG | GCAGATCTCG | CCTACGGGAGGCATCAG | AGTCAGTCAGCC | GGATTAGATACCCTAGTAGTC |
| (SEQ ID NO: 297) | CCTACGGGAGGCATCAG | GCAGATCTCG | CCTACGGGAGGCATCAG | AGTCAGTCAGCC | GGATTAGATACCCTAGTAGTC |
| (SEQ ID NO: 298) | CCTACGGGAGGCATCAG | GCAGATCTCG | CCTACGGGAGGCATCAG | AGTCAGTCAGCC | GGATTAGATACCCTAGTAGTC |
| (SEQ ID NO: 299) | CCTACGGGAGGCATCAG | GCAGATCTCG | CCTACGGGAGGCATCAG | AGTCAGTCAGCC | GGATTAGATACCCTAGTAGTC |
| (SEQ ID NO: 300) | CCTACGGGAGGCATCAG | GCAGATCTCG | CCTACGGGAGGCATCAG | AGTCAGTCAGCC | GGATTAGATACCCTAGTAGTC |
| (SEQ ID NO: 301) | CCTACGGGAGGCATCAG | GCAGATCTCG | CCTACGGGAGGCATCAG | AGTCAGTCAGCC | GGATTAGATACCCTAGTAGTC |
| (SEQ ID NO: 302) | CCTACGGGAGGCATCAG | GCAGATCTCG | CCTACGGGAGGCATCAG | AGTCAGTCAGCC | GGATTAGATACCCTAGTAGTC |
| (SEQ ID NO: 303) | CCTACGGGAGGCATCAG | GCAGATCTCG | CCTACGGGAGGCATCAG | AGTCAGTCAGCC | GGATTAGATACCCTAGTAGTC |
| (SEQ ID NO: 304) | CCTACGGGAGGCATCAG | GCAGATCTCG | CCTACGGGAGGCATCAG | AGTCAGTCAGCC | GGATTAGATACCCTAGTAGTC |
| (SEQ ID NO: 305) | CCTACGGGAGGCATCAG | GCAGATCTCG | CCTACGGGAGGCATCAG | AGTCAGTCAGCC | GGATTAGATACCCTAGTAGTC |
| (SEQ ID NO: 306) | CCTACGGGAGGCATCAG | GCAGATCTCG | CCTACGGGAGGCATCAG | AGTCAGTCAGCC | GGATTAGATACCCTAGTAGTC |
| (SEQ ID NO: 307) | CCTACGGGAGGCATCAG | GCAGATCTCG | CCTACGGGAGGCATCAG | AGTCAGTCAGCC | GGATTAGATACCCTAGTAGTC |
| (SEQ ID NO: 308) | CCTACGGGAGGCATCAG | GCAGATCTCG | CCTACGGGAGGCATCAG | AGTCAGTCAGCC | GGATTAGATACCCTAGTAGTC |
| (SEQ ID NO: 309) | CCTACGGGAGGCATCAG | GCAGATCTCG | CCTACGGGAGGCATCAG | AGTCAGTCAGCC | GGATTAGATACCCTAGTAGTC |
| (SEQ ID NO: 310) | CCTACGGGAGGCATCAG | GCAGATCTCG | CCTACGGGAGGCATCAG | AGTCAGTCAGCC | GGATTAGATACCCTAGTAGTC |
| (SEQ ID NO: 311) | CCTACGGGAGGCATCAG | GCAGATCTCG | CCTACGGGAGGCATCAG | AGTCAGTCAGCC | GGATTAGATACCCTAGTAGTC |
| (SEQ ID NO: 312) | CCTACGGGAGGCATCAG | GCAGATCTCG | CCTACGGGAGGCATCAG | AGTCAGTCAGCC | GGATTAGATACCCTAGTAGTC |
| (SEQ ID NO: 313) | CCTACGGGAGGCATCAG | GCAGATCTCG | CCTACGGGAGGCATCAG | AGTCAGTCAGCC | GGATTAGATACCCTAGTAGTC |
| (SEQ ID NO: 314) | CCTACGGGAGGCATCAG | GCAGATCTCG | CCTACGGGAGGCATCAG | AGTCAGTCAGCC | GGATTAGATACCCTAGTAGTC |
| (SEQ ID NO: 315) | CCTACGGGAGGCATCAG | GCAGATCTCG | CCTACGGGAGGCATCAG | AGTCAGTCAGCC | GGATTAGATACCCTAGTAGTC |
| (SEQ ID NO: 316) | CCTACGGGAGGCATCAG | GCAGATCTCG | CCTACGGGAGGCATCAG | AGTCAGTCAGCC | GGATTAGATACCCTAGTAGTC |
| (SEQ ID NO: 317) | CCTACGGGAGGCATCAG | GCAGATCTCG | CCTACGGGAGGCATCAG | AGTCAGTCAGCC | GGATTAGATACCCTAGTAGTC |
| (SEQ ID NO: 318) | CCTACGGGAGGCATCAG | GCAGATCTCG | CCTACGGGAGGCATCAG | AGTCAGTCAGCC | GGATTAGATACCCTAGTAGTC |
| (SEQ ID NO: 319) | CCTACGGGAGGCATCAG | GCAGATCTCG | CCTACGGGAGGCATCAG | AGTCAGTCAGCC | GGATTAGATACCCTAGTAGTC |
| (SEQ ID NO: 320) | CCTACGGGAGGCATCAG | GCAGATCTCG | CCTACGGGAGGCATCAG | AGTCAGTCAGCC | GGATTAGATACCCTAGTAGTC |
| (SEQ ID NO: 321) | CCTACGGGAGGCATCAG | GCAGATCTCG | CCTACGGGAGGCATCAG | AGTCAGTCAGCC | GGATTAGATACCCTAGTAGTC |
| (SEQ ID NO: 322) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 323) | CCTACGGGAGGCATCAG | GCAGATCTCG | CCTACGGGAGGCATCAG | AGTCAGTCAGCC | GGATTAGATACCCTAGTAGTC |
| (SEQ ID NO: 324) | CCTACGGGAGGCATCAG | GCAGATCTCG | CCTACGGGAGGCATCAG | AGTCAGTCAGCC | GGATTAGATACCCTAGTAGTC |
| (SEQ ID NO: 325) | CCTACGGGAGGCATCAG | GCAGATCTCG | CCTACGGGAGGCATCAG | AGTCAGTCAGCC | GGATTAGATACCCTAGTAGTC |
| (SEQ ID NO: 326) | CCTACGGGAGGCATCAG | GCAGATCTCG | CCTACGGGAGGCATCAG | AGTCAGTCAGCC | GGATTAGATACCCTAGTAGTC |
| (SEQ ID NO: 327) | CCTACGGGAGGCATCAG | GCAGATCTCG | CCTACGGGAGGCATCAG | AGTCAGTCAGCC | GGATTAGATACCCTAGTAGTC |
| (SEQ ID NO: 328) | CCTACGGGAGGCATCAG | GCAGATCTCG | CCTACGGGAGGCATCAG | AGTCAGTCAGCC | GGATTAGATACCCTAGTAGTC |
| (SEQ ID NO: 329) | CCTACGGGAGGCATCAG | GCAGATCTCG | CCTACGGGAGGCATCAG | AGTCAGTCAGCC | GGATTAGATACCCTAGTAGTC |
| (SEQ ID NO: 330) | CCTACGGGAGGCATCAG | GCAGATCTCG | CCTACGGGAGGCATCAG | AGTCAGTCAGCC | GGATTAGATACCCTAGTAGTC |
| (SEQ ID NO: 331) | CCTACGGGAGGCATCAG | GCAGATCTCG | CCTACGGGAGGCATCAG | AGTCAGTCAGCC | GGATTAGATACCCTAGTAGTC |
| (SEQ ID NO: 332) | CCTACGGGAGGCATCAG | GCAGATCTCG | CCTACGGGAGGCATCAG | AGTCAGTCAGCC | GGATTAGATACCCTAGTAGTC |
| (SEQ ID NO: 333) | CCTACGGGAGGCATCAG | GCAGATCTCG | CCTACGGGAGGCATCAG | AGTCAGTCAGCC | GGATTAGATACCCTAGTAGTC |
| (SEQ ID NO: 334) | CCTACGGGAGGCATCAG | GCAGATCTCG | CCTACGGGAGGCATCAG | AGTCAGTCAGCC | GGATTAGATACCCTAGTAGTC |
| (SEQ ID NO: 335) | CCTACGGGAGGCATCAG | GCAGATCTCG | CCTACGGGAGGCATCAG | AGTCAGTCAGCC | GGATTAGATACCCTAGTAGTC |
| (SEQ ID NO: 336) | CCTACGGGAGGCATCAG | GCAGATCTCG | CCTACGGGAGGCATCAG | AGTCAGTCAGCC | GGATTAGATACCCTAGTAGTC |
| (SEQ ID NO: 337) | CCTACGGGAGGCATCAG | GCAGATCTCG | CCTACGGGAGGCATCAG | AGTCAGTCAGCC | GGATTAGATACCCTAGTAGTC |
| (SEQ ID NO: 338) | CCTACGGGAGGCATCAG | GCAGATCTCG | CCTACGGGAGGCATCAG | AGTCAGTCAGCC | GGATTAGATACCCTAGTAGTC |
| (SEQ ID NO: 339) | CCTACGGGAGGCATCAG | GCAGATCTCG | CCTACGGGAGGCATCAG | AGTCAGTCAGCC | GGATTAGATACCCTAGTAGTC |
| (SEQ ID NO: 340) | CCTACGGGAGGCATCAG | GCAGATCTCG | CCTACGGGAGGCATCAG | AGTCAGTCAGCC | GGATTAGATACCCTAGTAGTC |
| (SEQ ID NO: 341) | CCTACGGGAGGCATCAG | GCAGATCTCG | CCTACGGGAGGCATCAG | AGTCAGTCAGCC | GGATTAGATACCCTAGTAGTC |
| (SEQ ID NO: 342) | CCTACGGGAGGCATCAG | GCAGATCTCG | CCTACGGGAGGCATCAG | AGTCAGTCAGCC | GGATTAGATACCCTAGTAGTC |
| (SEQ ID NO: 343) | CCTACGGGAGGCATCAG | GCAGATCTCG | CCTACGGGAGGCATCAG | AGTCAGTCAGCC | GGATTAGATACCCTAGTAGTC |
| (SEQ ID NO: 344) | CCTACGGGAGGCATCAG | GCAGATCTCG | CCTACGGGAGGCATCAG | AGTCAGTCAGCC | GGATTAGATACCCTAGTAGTC |
| (SEQ ID NO: 345) | CCTACGGGAGGCATCAG | GCAGATCTCG | CCTACGGGAGGCATCAG | AGTCAGTCAGCC | GGATTAGATACCCTAGTAGTC |
| (SEQ ID NO: 346) | CCTACGGGAGGCATCAG | GCAGATCTCG | CCTACGGGAGGCATCAG | AGTCAGTCAGCC | GGATTAGATACCCTAGTAGTC |
| (SEQ ID NO: 347) | CCTACGGGAGGCATCAG | GCAGATCTCG | CCTACGGGAGGCATCAG | AGTCAGTCAGCC | GGATTAGATACCCTAGTAGTC |
| (SEQ ID NO: 348) | CCTACGGGAGGCATCAG | GCAGATCTCG | CCTACGGGAGGCATCAG | AGTCAGTCAGCC | GGATTAGATACCCTAGTAGTC |
| (SEQ ID NO: 349) | CCTACGGGAGGCATCAG | GCAGATCTCG | CCTACGGGAGGCATCAG | AGTCAGTCAGCC | GGATTAGATACCCTAGTAGTC |
| (SEQ ID NO: 350) | CCTACGGGAGGCATCAG | GCAGATCTCG | CCTACGGGAGGCATCAG | AGTCAGTCAGCC | GGATTAGATACCCTAGTAGTC |
| (SEQ ID NO: 351) | CCTACGGGAGGCATCAG | GCAGATCTCG | CCTACGGGAGGCATCAG | AGTCAGTCAGCC | GGATTAGATACCCTAGTAGTC |
| (SEQ ID NO: 352) | CCTACGGGAGGCATCAG | GCAGATCTCG | CCTACGGGAGGCATCAG | AGTCAGTCAGCC | GGATTAGATACCCTAGTAGTC |
| (SEQ ID NO: 353) | CCTACGGGAGGCATCAG | GCAGATCTCG | CCTACGGGAGGCATCAG | AGTCAGTCAGCC | GGATTAGATACCCTAGTAGTC |
| (SEQ ID NO: 354) | CCTACGGGAGGCATCAG | GCAGATCTCG | CCTACGGGAGGCATCAG | AGTCAGTCAGCC | GGATTAGATACCCTAGTAGTC |
| (SEQ ID NO: 355) | CCTACGGGAGGCATCAG | GCAGATCTCG | CCTACGGGAGGCATCAG | AGTCAGTCAGCC | GGATTAGATACCCTAGTAGTC |
| (SEQ ID NO: 356) | CCTACGGGAGGCATCAG | GCAGATCTCG | CCTACGGGAGGCATCAG | AGTCAGTCAGCC | GGATTAGATACCCTAGTAGTC |
| (SEQ ID NO: 357) | CCTACGGGAGGCATCAG | GCAGATCTCG | CCTACGGGAGGCATCAG | AGTCAGTCAGCC | GGATTAGATACCCTAGTAGTC |
| (SEQ ID NO: 358) | CCTACGGGAGGCATCAG | GCAGATCTCG | CCTACGGGAGGCATCAG | AGTCAGTCAGCC | GGATTAGATACCCTAGTAGTC |
| (SEQ ID NO: 359) | CCTACGGGAGGCATCAG | GCAGATCTCG | CCTACGGGAGGCATCAG | AGTCAGTCAGCC | GGATTAGATACCCTAGTAGTC |

TABLE 2-continued

| | forward primer binding site fragment | 5' universal sequence fragment | barcode sequence fragment | 3' universal sequence fragment | reverse primer binding site fragment |
|---|---|---|---|---|---|
| (SEQ ID NO: 360) | CCTACGGGAGGCATCAG | GCAGATCTCG | CCTACGGGAGGCATCAG | AGTCAGTCAGCC | GGATTAGATACCCTAGTAGTC |
| (SEQ ID NO: 361) | CCTACGGGAGGCATCAG | GCAGATCTCG | CCTACGGGAGGCATCAG | AGTCAGTCAGCC | GGATTAGATACCCTAGTAGTC |
| (SEQ ID NO: 362) | CCTACGGGAGGCATCAG | GCAGATCTCG | CCTACGGGAGGCATCAG | AGTCAGTCAGCC | GGATTAGATACCCTAGTAGTC |
| (SEQ ID NO: 363) | CCTACGGGAGGCATCAG | GCAGATCTCG | CCTACGGGAGGCATCAG | AGTCAGTCAGCC | GGATTAGATACCCTAGTAGTC |
| (SEQ ID NO: 364) | CCTACGGGAGGCATCAG | GCAGATCTCG | CCTACGGGAGGCATCAG | AGTCAGTCAGCC | GGATTAGATACCCTAGTAGTC |
| (SEQ ID NO: 365) | CCTACGGGAGGCATCAG | GCAGATCTCG | CCTACGGGAGGCATCAG | AGTCAGTCAGCC | GGATTAGATACCCTAGTAGTC |
| (SEQ ID NO: 366) | CCTACGGGAGGCATCAG | GCAGATCTCG | CCTACGGGAGGCATCAG | AGTCAGTCAGCC | GGATTAGATACCCTAGTAGTC |
| (SEQ ID NO: 367) | CCTACGGGAGGCATCAG | GCAGATCTCG | CCTACGGGAGGCATCAG | AGTCAGTCAGCC | GGATTAGATACCCTAGTAGTC |
| (SEQ ID NO: 368) | CCTACGGGAGGCATCAG | GCAGATCTCG | CCTACGGGAGGCATCAG | AGTCAGTCAGCC | GGATTAGATACCCTAGTAGTC |
| (SEQ ID NO: 369) | CCTACGGGAGGCATCAG | GCAGATCTCG | CCTACGGGAGGCATCAG | AGTCAGTCAGCC | GGATTAGATACCCTAGTAGTC |
| (SEQ ID NO: 370) | CCTACGGGAGGCATCAG | GCAGATCTCG | CCTACGGGAGGCATCAG | AGTCAGTCAGCC | GGATTAGATACCCTAGTAGTC |
| (SEQ ID NO: 371) | CCTACGGGAGGCATCAG | GCAGATCTCG | CCTACGGGAGGCATCAG | AGTCAGTCAGCC | GGATTAGATACCCTAGTAGTC |
| (SEQ ID NO: 372) | CCTACGGGAGGCATCAG | GCAGATCTCG | CCTACGGGAGGCATCAG | AGTCAGTCAGCC | GGATTAGATACCCTAGTAGTC |
| (SEQ ID NO: 373) | CCTACGGGAGGCATCAG | GCAGATCTCG | CCTACGGGAGGCATCAG | AGTCAGTCAGCC | GGATTAGATACCCTAGTAGTC |
| (SEQ ID NO: 374) | CCTACGGGAGGCATCAG | GCAGATCTCG | CCTACGGGAGGCATCAG | AGTCAGTCAGCC | GGATTAGATACCCTAGTAGTC |
| (SEQ ID NO: 375) | CCTACGGGAGGCATCAG | GCAGATCTCG | CCTACGGGAGGCATCAG | AGTCAGTCAGCC | GGATTAGATACCCTAGTAGTC |
| (SEQ ID NO: 376) | CCTACGGGAGGCATCAG | GCAGATCTCG | CCTACGGGAGGCATCAG | AGTCAGTCAGCC | GGATTAGATACCCTAGTAGTC |
| (SEQ ID NO: 377) | CCTACGGGAGGCATCAG | GCAGATCTCG | CCTACGGGAGGCATCAG | AGTCAGTCAGCC | GGATTAGATACCCTAGTAGTC |
| (SEQ ID NO: 378) | CCTACGGGAGGCATCAG | GCAGATCTCG | CCTACGGGAGGCATCAG | AGTCAGTCAGCC | GGATTAGATACCCTAGTAGTC |
| (SEQ ID NO: 379) | CCTACGGGAGGCATCAG | GCAGATCTCG | CCTACGGGAGGCATCAG | AGTCAGTCAGCC | GGATTAGATACCCTAGTAGTC |
| (SEQ ID NO: 380) | CCTACGGGAGGCATCAG | GCAGATCTCG | CCTACGGGAGGCATCAG | AGTCAGTCAGCC | GGATTAGATACCCTAGTAGTC |
| (SEQ ID NO: 381) | CCTACGGGAGGCATCAG | GCAGATCTCG | CCTACGGGAGGCATCAG | AGTCAGTCAGCC | GGATTAGATACCCTAGTAGTC |
| (SEQ ID NO: 382) | CCTACGGGAGGCATCAG | GCAGATCTCG | CCTACGGGAGGCATCAG | AGTCAGTCAGCC | GGATTAGATACCCTAGTAGTC |
| (SEQ ID NO: 383) | CCTACGGGAGGCATCAG | GCAGATCTCG | CCTACGGGAGGCATCAG | AGTCAGTCAGCC | GGATTAGATACCCTAGTAGTC |
| (SEQ ID NO: 384) | CCTACGGGAGGCATCAG | GCAGATCTCG | CCTACGGGAGGCATCAG | AGTCAGTCAGCC | GGATTAGATACCCTAGTAGTC |

In one illustrative aspect, the control composition for sequencing or chemical analyses comprises a nucleic acid construct comprising at least one barcode sequence fragment linked at its 5' or 3' end to at least one universal sequence fragment. In another embodiment, the nucleic acid construct comprises at least a first and a second universal sequence fragment, and the first universal sequence fragment can be linked to the 5' end of the barcode sequence fragment and the second universal sequence fragment can be linked to the 3' end of the barcode sequence fragment. In one aspect, the universal sequence fragments can be extended as needed to make the nucleic acid construct longer for different applications such as whole genome sequencing where short inserts may be lost.

In yet another embodiment, a universal sequence fragment is not included in the nucleic acid construct (e.g., for microarray applications). In this microarray embodiment, primer binding site fragments are also not included. The complimentary sequence to each barcode sequence fragment may be spotted onto the microarray alongside nucleic acid sequences of interest to detect the barcode sequence fragments. The barcode sequence fragment detected would be in a fixed location that would identify which barcode sequence fragment was present.

In various embodiments, the universal sequence fragments can be from about 10 base pairs in length to about 270 base pairs in length, from about 10 base pairs in length to about 260 base pairs in length, from about 10 base pairs in length to about 250 base pairs in length, from about 10 base pairs in length to about 240 base pairs in length, from about 10 base pairs in length to about 230 base pairs in length, from about 10 base pairs in length to about 220 base pairs in length, from about 10 base pairs in length to about 210 base pairs in length, from about 10 base pairs in length to about 200 base pairs in length, from about 10 base pairs in length to about 190 base pairs in length, from about 10 base pairs in length to about 180 base pairs in length, from about 10 base pairs in length to about 170 base pairs in length, from about base pairs in length to about 160 base pairs in length, from about 10 base pairs in length to about 150 base pairs in length, from about 10 base pairs in length to about 140 base pairs in length, from about 10 base pairs in length to about 130 base pairs in length, from about 10 base pairs in length to about 120 base pairs in length, from about 10 base pairs in length to about 110 base pairs in length, from about 10 base pairs in length to about 100 base pairs in length, from about 10 base pairs in length to about 90 base pairs in length, from about 10 base pairs in length to about 80 base pairs in length, from about 10 base pairs in length to about 70 base pairs in length, from about 10 base pairs in length to about 60 base pairs in length, from about 10 base pairs in length to about 50 base pairs in length, from about 10 base pairs in length to about 40 base pairs in length, from about 10 base pairs in length to about 30 base pairs in length, from about 10 base pairs in length to about 20 base pairs in length, from about 10 base pairs in length to about 15 base pairs in length, from about 8 base pairs in length to about 15 base pairs in length, or from about 8 base pairs in length to about 12 base pairs in length.

Figure 5:
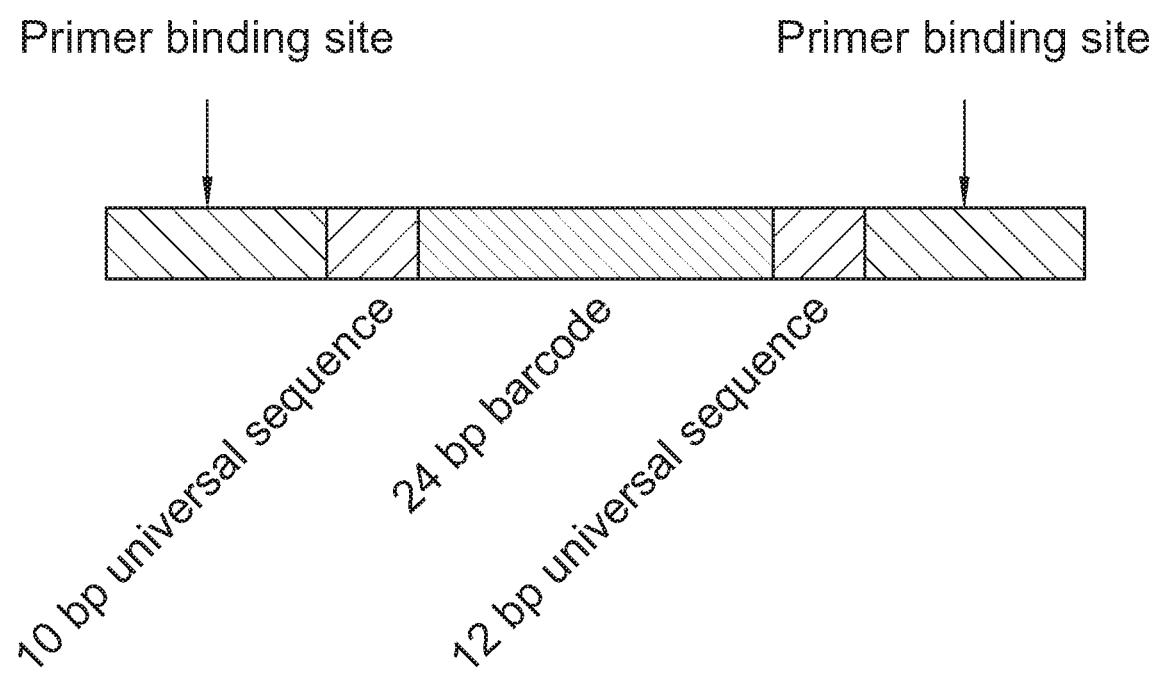
FIG. 5 shows schematically an exemplary nucleic acid construct as described herein comprising the unique barcode sequence fragment (e.g., 24 bases) that is not present in any known genome. The exemplary nucleic acid construct also comprises 10 bp and 12 bp universal sequence fragments and primer binding sites at the 5' and 3' ends of the nucleic acid construct.
Figure 7A:
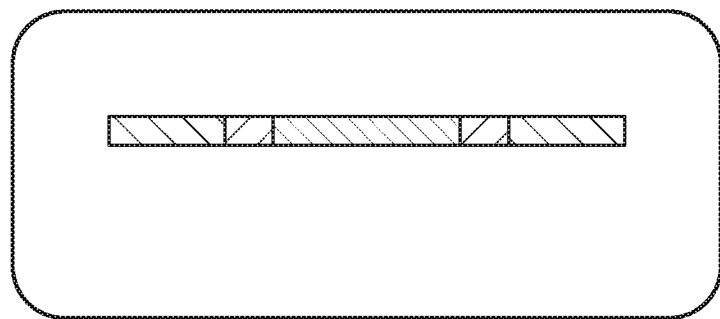
FIGS. 7A-7B show schematically the direct encapsulation of exemplary nucleic acid constructs as described herein without a plasmid or genome backbone. In various embodiments, the nucleic acid construct comprises (FIG. 7A) or lacks (FIG. 7B) primer binding site sequence fragments.
Figure 7B:
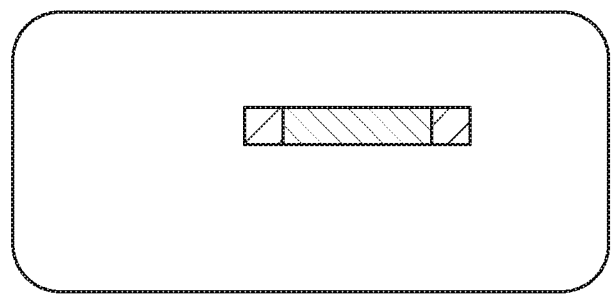

In embodiments for amplicon sequencing or chemical analyses involving amplicon sequencing to detect the nucleic acid construct of the control composition, the nucleic acid construct can further comprise at least a first and a second primer binding site fragment. In this aspect, the primers can be any primers of interest. In this embodiment, the first primer binding site fragment is linked at its 3' end to the 5' end of the first universal sequence fragment and the second primer binding site fragment is linked at its 5' end to the 3' end of the second universal sequence fragment (see FIG. 5 for an example). In embodiments for whole genome sequencing, the nucleic acid construct may lack primer binding site fragments (see FIG. 7B for an example). In embodiments where primer binding site fragments are included in the nucleic acid construct, the primer binding site fragments can range in length from about 15 base pairs to about 28 base pairs, from about 15 base pairs to about 26 base pairs, from about 15 base pairs to about 24 base pairs, from about 15 base pairs to about 22 base pairs, from about 15 base pairs to about 20 base pairs, from about 16 base pairs to about 22 base pairs, from about 16 base pairs to about 20 base pairs, from about 17 base pairs to about 20 base pairs, or can be about 18 base pairs.

In all of the various embodiments described above, the entire nucleic acid construct, not including plasmid sequence if a plasmid is present, can range in length from about 80 base pairs to about 300 base pairs, from about 80 base pairs to about 290 base pairs, from about 80 base pairs to about 280 base pairs, from about 80 base pairs to about 270 base pairs, from about 80 base pairs to about 260 base pairs, from about 80 base pairs to about 250 base pairs, from about 80 base pairs to about 240 base pairs, from about 80 base pairs to about 230 base pairs, from about 80 base pairs to about 220 base pairs, from about 80 base pairs to about 210 base pairs, from about 80 base pairs to about 200 base pairs, from about 80 base pairs to about 190 base pairs, from about 80 base pairs to about 180 base pairs, from about 80 base pairs to about 170 base pairs, or from about 80 base pairs to about 160 base pairs.

Various embodiments of the nucleic acid constructs, including the forward and reverse primer binding site fragments, the 5' and 3' universal sequence fragments, and the barcode sequence fragment are shown in Table 2 above having SEQ ID NOS:1 to 384. The corresponding full sequences are also shown as SEQ ID NOS:385 to 768 in Table 3 below. These embodiments have primer binding site sequence fragments similar to the nucleic acid construct exemplified in FIG. 5.

TABLE 3

|  | full sequence |
|---|---|
| (SEQ ID NO: 385) | CCTACGGGAGGCATCAGGCAGATCTCGTCCCTTGTCTCCACGAGACTGATTAGTCAGTCAGCCGGATTAGATACCCTAGTAGTC |
| (SEQ ID NO: 386) | CCTACGGGAGGCATCAGGCAGATCTCGGCTGTACGGATTATCACCAGGTGTAGTCAGTCAGCCGGATTAGATACCCTAGTAGTC |
| (SEQ ID NO: 387) | CCTACGGGAGGCATCAGGCAGATCTCGTGGTCAACGATACATCGCGTTGACAGTCAGTCAGCCGGATTAGATACCCTAGTAGTC |
| (SEQ ID NO: 388) | CCTACGGGAGGCATCAGGCAGATCTCGATCGCACAGTAAGCACATAGTCGTAGTCAGTCAGCCGGATTAGATACCCTAGTAGTC |
| (SEQ ID NO: 389) | CCTACGGGAGGCATCAGGCAGATCTCGGTCGTGTAGCCTGGCAAATACACTAGTCAGTCAGCCGGATTAGATACCCTAGTAGTC |
| (SEQ ID NO: 390) | CCTACGGGAGGCATCAGGCAGATCTCGAGCGGAGGTTAGGTCATGCTCCAGAGTCAGTCAGCCGGATTAGATACCCTAGTAGTC |
| (SEQ ID NO: 391) | CCTACGGGAGGCATCAGGCAGATCTCGATCCTTTGGTTCCCTAGTAAGCTGAGTCAGTCAGCCGGATTAGATACCCTAGTAGTC |
| (SEQ ID NO: 392) | CCTACGGGAGGCATCAGGCAGATCTCGTACAGCGCATACTTACCGACGAGTAGTCAGTCAGCCGGATTAGATACCCTAGTAGTC |
| (SEQ ID NO: 393) | CCTACGGGAGGCATCAGGCAGATCTCGACCGGTATGTACGCTTAGATGTAGAGTCAGTCAGCCGGATTAGATACCCTAGTAGTC |
| (SEQ ID NO: 394) | CCTACGGGAGGCATCAGGCAGATCTCGAATTGTGTCGGAAAGACGTAGCGGAGTCAGTCAGCCGGATTAGATACCCTAGTAGTC |
| (SEQ ID NO: 395) | CCTACGGGAGGCATCAGGCAGATCTCGTGCATACACTGGTTACCTTACACCAGTCAGTCAGCCGGATTAGATACCCTAGTAGTC |
| (SEQ ID NO: 396) | CCTACGGGAGGCATCAGGCAGATCTCGAGTCGAACGAGGTGACTAATGGCCAGTCAGTCAGCCGGATTAGATACCCTAGTAGTC |
| (SEQ ID NO: 397) | CCTACGGGAGGCATCAGGCAGATCTCGACCAGTGACTCACTCTCTCACTTGAGTCAGTCAGCCGGATTAGATACCCTAGTAGTC |
| (SEQ ID NO: 398) | CCTACGGGAGGCATCAGGCAGATCTCGGAATACCAAGTCATTGCAAGCAACAGTCAGTCAGCCGGATTAGATACCCTAGTAGTC |
| (SEQ ID NO: 399) | CCTACGGGAGGCATCAGGCAGATCTCGGTAGATCGTGTACACGTGACATGTAGTCAGTCAGCCGGATTAGATACCCTAGTAGTC |
| (SEQ ID NO: 400) | CCTACGGGAGGCATCAGGCAGATCTCGTAACGTGTGTGCCACAGTTGAAGTAGTCAGTCAGCCGGATTAGATACCCTAGTAGTC |
| (SEQ ID NO: 401) | CCTACGGGAGGCATCAGGCAGATCTCGCATTATGGCGTGCTAGGATCACTGAGTCAGTCAGCCGGATTAGATACCCTAGTAGTC |

TABLE 3-continued

| | full sequence |
|---|---|
| (SEQ ID NO: 402) | CCTACGGGAGGCATCAGGCAGATCTCGCCAATACGCCTGGATGACCCAAATAGTCAGTCAGCCGGATTAGATACCCTAGTAGTC |
| (SEQ ID NO: 403) | CCTACGGGAGGCATCAGGCAGATCTCGGATCTGCGATCCACCGGAGTAGGAAGTCAGTCAGCCGGATTAGATACCCTAGTAGTC |
| (SEQ ID NO: 404) | CCTACGGGAGGCATCAGGCAGATCTCGCAGCTCATCAGCTGAGGACTACCTAGTCAGTCAGCCGGATTAGATACCCTAGTAGTC |
| (SEQ ID NO: 405) | CCTACGGGAGGCATCAGGCAGATCTCGCAAACAACAGCTCAATCGGCTTGCAGTCAGTCAGCCGGATTAGATACCCTAGTAGTC |
| (SEQ ID NO: 406) | CCTACGGGAGGCATCAGGCAGATCTCGGCAACACCATCCAACACTCGATCGAGTCAGTCAGCCGGATTAGATACCCTAGTAGTC |
| (SEQ ID NO: 407) | CCTACGGGAGGCATCAGGCAGATCTCGGCGATATATCGCTGACCGGCTGTTAGTCAGTCAGCCGGATTAGATACCCTAGTAGTC |
| (SEQ ID NO: 408) | CCTACGGGAGGCATCAGGCAGATCTCGCGAGCAATCCTAGGAGGAGCAATAAGTCAGTCAGCCGGATTAGATACCCTAGTAGTC |
| (SEQ ID NO: 409) | CCTACGGGAGGCATCAGGCAGATCTCGAGTCGTGCACATAGCGACGAAGACAGTCAGTCAGCCGGATTAGATACCCTAGTAGTC |
| (SEQ ID NO: 410) | CCTACGGGAGGCATCAGGCAGATCTCGGTATCTGCGCGTCTTCCCTAACTCAGTCAGTCAGCCGGATTAGATACCCTAGTAGTC |
| (SEQ ID NO: 411) | CCTACGGGAGGCATCAGGCAGATCTCGCGAGGGAAAGTCTGGAAGAACGGCAGTCAGTCAGCCGGATTAGATACCCTAGTAGTC |
| (SEQ ID NO: 412) | CCTACGGGAGGCATCAGGCAGATCTCGCAAATTCGGGATGCTAGACACTACAGTCAGTCAGCCGGATTAGATACCCTAGTAGTC |
| (SEQ ID NO: 413) | CCTACGGGAGGCATCAGGCAGATCTCGAGATTGACCAACTTGGATTGAACGAGTCAGTCAGCCGGATTAGATACCCTAGTAGTC |
| (SEQ ID NO: 414) | CCTACGGGAGGCATCAGGCAGATCTCGAGTTACGAGCTAGATATACCAGTGAGTCAGTCAGCCGGATTAGATACCCTAGTAGTC |
| (SEQ ID NO: 415) | CCTACGGGAGGCATCAGGCAGATCTCGGCATATGCACTGAACAAACTGCCAAGTCAGTCAGCCGGATTAGATACCCTAGTAGTC |
| (SEQ ID NO: 416) | CCTACGGGAGGCATCAGGCAGATCTCGCAACTCCCGTGAGTAGACATGTGTAGTCAGTCAGCCGGATTAGATACCCTAGTAGTC |
| (SEQ ID NO: 417) | CCTACGGGAGGCATCAGGCAGATCTCGTTGCGTTAGCAGTACAGTTACGCGAGTCAGTCAGCCGGATTAGATACCCTAGTAGTC |
| (SEQ ID NO: 418) | CCTACGGGAGGCATCAGGCAGATCTCGTACGAGCCCTAACAAGCCCTAGTAAGTCAGTCAGCCGGATTAGATACCCTAGTAGTC |
| (SEQ ID NO: 419) | CCTACGGGAGGCATCAGGCAGATCTCGCACTACGCTAGATAGTGTCGGATCAGTCAGTCAGCCGGATTAGATACCCTAGTAGTC |
| (SEQ ID NO: 420) | CCTACGGGAGGCATCAGGCAGATCTCGTGCAGTCCTCGACTGAGCTCTGCAAGTCAGTCAGCCGGATTAGATACCCTAGTAGTC |
| (SEQ ID NO: 421) | CCTACGGGAGGCATCAGGCAGATCTCGACCATAGCTCCGCTTCGACTTTCCAGTCAGTCAGCCGGATTAGATACCCTAGTAGTC |
| (SEQ ID NO: 422) | CCTACGGGAGGCATCAGGCAGATCTCGTCGACATCTCTTGTCATAAGAACCAGTCAGTCAGCCGGATTAGATACCCTAGTAGTC |
| (SEQ ID NO: 423) | CCTACGGGAGGCATCAGGCAGATCTCGGAACACTTTGGAGTCCGCAAGTTAAGTCAGTCAGCCGGATTAGATACCCTAGTAGTC |
| (SEQ ID NO: 424) | CCTACGGGAGGCATCAGGCAGATCTCGGAGCCATCTGTACGTAGAGCTCTCAGTCAGTCAGCCGGATTAGATACCCTAGTAGTC |
| (SEQ ID NO: 425) | CCTACGGGAGGCATCAGGCAGATCTCGTTGGGTACACGTCCTCTGAGAGCTAGTCAGTCAGCCGGATTAGATACCCTAGTAGTC |
| (SEQ ID NO: 426) | CCTACGGGAGGCATCAGGCAGATCTCGAAGGCGCTCCTTCCTCGATGCAGTAGTCAGTCAGCCGGATTAGATACCCTAGTAGTC |
| (SEQ ID NO: 427) | CCTACGGGAGGCATCAGGCAGATCTCGTAATACGGATCGGCGGACTATTCAAGTCAGTCAGCCGGATTAGATACCCTAGTAGTC |
| (SEQ ID NO: 428) | CCTACGGGAGGCATCAGGCAGATCTCGTCGGAATTAGACCGTGCACAATTGAGTCAGTCAGCCGGATTAGATACCCTAGTAGTC |
| (SEQ ID NO: 429) | CCTACGGGAGGCATCAGGCAGATCTCGTGTGAATTCGGACGGCCTAAGTTCAGTCAGTCAGCCGGATTAGATACCCTAGTAGTC |
| (SEQ ID NO: 430) | CCTACGGGAGGCATCAGGCAGATCTCGCATTCGTGGCGTAGCGCTCACATCAGTCAGTCAGCCGGATTAGATACCCTAGTAGTC |
| (SEQ ID NO: 431) | CCTACGGGAGGCATCAGGCAGATCTCGTACTACGTGGCCTGGTTATGGCACAGTCAGTCAGCCGGATTAGATACCCTAGTAGTC |
| (SEQ ID NO: 432) | CCTACGGGAGGCATCAGGCAGATCTCGGGCCAGTTCCTACGAGGTTCTGATAGTCAGTCAGCCGGATTAGATACCCTAGTAGTC |
| (SEQ ID NO: 433) | CCTACGGGAGGCATCAGGCAGATCTCGGATGTTCGCTAGAACTCCTGTGGAAGTCAGTCAGCCGGATTAGATACCCTAGTAGTC |
| (SEQ ID NO: 434) | CCTACGGGAGGCATCAGGCAGATCTCGCTATCTCCTGTCTAATGGTCGTAGAGTCAGTCAGCCGGATTAGATACCCTAGTAGTC |
| (SEQ ID NO: 435) | CCTACGGGAGGCATCAGGCAGATCTCGACTCACAGGAATTTGCACCGTCGAAGTCAGTCAGCCGGATTAGATACCCTAGTAGTC |
| (SEQ ID NO: 436) | CCTACGGGAGGCATCAGGCAGATCTCGATGATGAGCCTCTGCTACAGACGTAGTCAGTCAGCCGGATTAGATACCCTAGTAGTC |
| (SEQ ID NO: 437) | CCTACGGGAGGCATCAGGCAGATCTCGGTCGACAGAGGAATGGCCTGACTAAGTCAGTCAGCCGGATTAGATACCCTAGTAGTC |
| (SEQ ID NO: 438) | CCTACGGGAGGCATCAGGCAGATCTCGTGTCGCAAATAGACGCACATACAAAGTCAGTCAGCCGGATTAGATACCCTAGTAGTC |
| (SEQ ID NO: 439) | CCTACGGGAGGCATCAGGCAGATCTCGCATCCCTCTACTTGAGTGGTCTGTAGTCAGTCAGCCGGATTAGATACCCTAGTAGTC |
| (SEQ ID NO: 440) | CCTACGGGAGGCATCAGGCAGATCTCGTATACCGCTGCGGATAGCACTCGTAGTCAGTCAGCCGGATTAGATACCCTAGTAGTC |

TABLE 3-continued full sequence (SEQ ID NO: 441) CCTACGGGAGGCATCAGGCAGATCTCGAGTTGAGGCATTTAGCGCGAACTTAGTCAGTCAGCCGGATTAGATACCCTAGTAGTC
(SEQ ID NO: 442) CCTACGGGAGGCATCAGGCAGATCTCGACAATAGACACCCATACACGCACCAGTCAGTCAGCCGGATTAGATACCCTAGTAGTC
(SEQ ID NO: 443) CCTACGGGAGGCATCAGGCAGATCTCGCGGTCAATTGACACCTCAGTCAAGAGTCAGTCAGCCGGATTAGATACCCTAGTAGTC
(SEQ ID NO: 444) CCTACGGGAGGCATCAGGCAGATCTCGGTGGAGTCTCATTCGACCAAACACAGTCAGTCAGCCGGATTAGATACCCTAGTAGTC
(SEQ ID NO: 445) CCTACGGGAGGCATCAGGCAGATCTCGGCTCGAAGATTCCCACCCAGTAACAGTCAGTCAGCCGGATTAGATACCCTAGTAGTC
(SEQ ID NO: 446) CCTACGGGAGGCATCAGGCAGATCTCGAGGCTTACGTGTATATCGCGATGAAGTCAGTCAGCCGGATTAGATACCCTAGTAGTC
(SEQ ID NO: 447) CCTACGGGAGGCATCAGGCAGATCTCGTCTCTACCACTCCGCCGGTAATCTAGTCAGTCAGCCGGATTAGATACCCTAGTAGTC
(SEQ ID NO: 448) CCTACGGGAGGCATCAGGCAGATCTCGACTTCCAACTTCCCGATGCCTTGAAGTCAGTCAGCCGGATTAGATACCCTAGTAGTC
(SEQ ID NO: 449) CCTACGGGAGGCATCAGGCAGATCTCGCTCACCTAGGAAAGCAGGCACGAAAGTCAGTCAGCCGGATTAGATACCCTAGTAGTC
(SEQ ID NO: 450) CCTACGGGAGGCATCAGGCAGATCTCGGTGTTGTCGTGCTACGCAGCACTAAGTCAGTCAGCCGGATTAGATACCCTAGTAGTC
(SEQ ID NO: 451) CCTACGGGAGGCATCAGGCAGATCTCGCCACAGATCGATCGCTTAGTGCTGAGTCAGTCAGCCGGATTAGATACCCTAGTAGTC
(SEQ ID NO: 452) CCTACGGGAGGCATCAGGCAGATCTCGTATCGACACAAGCAAAGTTTGCGAAGTCAGTCAGCCGGATTAGATACCCTAGTAGTC
(SEQ ID NO: 453) CCTACGGGAGGCATCAGGCAGATCTCGGATTCCGGCTCATCGAGCCGATCTAGTCAGTCAGCCGGATTAGATACCCTAGTAGTC
(SEQ ID NO: 454) CCTACGGGAGGCATCAGGCAGATCTCGCGTAATTGCCGCCTCATCATGTTCAGTCAGTCAGCCGGATTAGATACCCTAGTAGTC
(SEQ ID NO: 455) CCTACGGGAGGCATCAGGCAGATCTCGGGTGACTAGTTCCCAGGGACTTCTAGTCAGTCAGCCGGATTAGATACCCTAGTAGTC
(SEQ ID NO: 456) CCTACGGGAGGCATCAGGCAGATCTCGATGGGTTCCGTCGCAATCCTTGCGAGTCAGTCAGCCGGATTAGATACCCTAGTAGTC
(SEQ ID NO: 457) CCTACGGGAGGCATCAGGCAGATCTCGTAGGCATGCTTGCCTGCTTCCTTCAGTCAGTCAGCCGGATTAGATACCCTAGTAGTC
(SEQ ID NO: 458) CCTACGGGAGGCATCAGGCAGATCTCGAACTAGTTCAGGCAAGGCACAAGGAGTCAGTCAGCCGGATTAGATACCCTAGTAGTC
(SEQ ID NO: 459) CCTACGGGAGGCATCAGGCAGATCTCGATTCTGCCGAAGGGCCTATAAGTCAGTCAGCCGGATTAGATACCCTAGTAGTC
(SEQ ID NO: 460) CCTACGGGAGGCATCAGGCAGATCTCGAGCATGTCCCGTTCCATTTCATGCAGTCAGTCAGCCGGATTAGATACCCTAGTAGTC
(SEQ ID NO: 461) CCTACGGGAGGCATCAGGCAGATCTCGGTACGATATGACTCGGCGATCATCAGTCAGTCAGCCGGATTAGATACCCTAGTAGTC
(SEQ ID NO: 462) CCTACGGGAGGCATCAGGCAGATCTCGGTGGTGGTTTCCGTTTCACGCGAAAGTCAGTCAGCCGGATTAGATACCCTAGTAGTC
(SEQ ID NO: 463) CCTACGGGAGGCATCAGGCAGATCTCGTAGTATGCGCAAACAAGAACCTTGAGTCAGTCAGCCGGATTAGATACCCTAGTAGTC
(SEQ ID NO: 464) CCTACGGGAGGCATCAGGCAGATCTCGTGCGCTGAATGTTACTCTCTTAGCAGTCAGTCAGCCGGATTAGATACCCTAGTAGTC
(SEQ ID NO: 465) CCTACGGGAGGCATCAGGCAGATCTCGATGGCTGTCAGTAACTGTTCGCGCAGTCAGTCAGCCGGATTAGATACCCTAGTAGTC
(SEQ ID NO: 466) CCTACGGGAGGCATCAGGCAGATCTCGGTTCTCTTCTCGCGAAGCATCTACAGTCAGTCAGCCGGATTAGATACCCTAGTAGTC
(SEQ ID NO: 467) CCTACGGGAGGCATCAGGCAGATCTCGCGTAAGATGCCTGTTTGGCCACACAGTCAGTCAGCCGGATTAGATACCCTAGTAGTC
(SEQ ID NO: 468) CCTACGGGAGGCATCAGGCAGATCTCGGCGTTCTAGCTGTCAGGTTGCCCAAGTCAGTCAGCCGGATTAGATACCCTAGTAGTC
(SEQ ID NO: 469) CCTACGGGAGGCATCAGGCAGATCTCGGTTGTTCTGGGATCATTCCACTCAAGTCAGTCAGCCGGATTAGATACCCTAGTAGTC
(SEQ ID NO: 470) CCTACGGGAGGCATCAGGCAGATCTCGGGACTTCCAGCTGTCACATCACGAAGTCAGTCAGCCGGATTAGATACCCTAGTAGTC
(SEQ ID NO: 471) CCTACGGGAGGCATCAGGCAGATCTCGCTCACAACCGTGCGACATTTCTCTAGTCAGTCAGCCGGATTAGATACCCTAGTAGTC
(SEQ ID NO: 472) CCTACGGGAGGCATCAGGCAGATCTCGCTGCTATTCCTCGGACGTTAACTAAGTCAGTCAGCCGGATTAGATACCCTAGTAGTC
(SEQ ID NO: 473) CCTACGGGAGGCATCAGGCAGATCTCGATGTCACCGCTGTAGCAGTTGCGTAGTCAGTCAGCCGGATTAGATACCCTAGTAGTC
(SEQ ID NO: 474) CCTACGGGAGGCATCAGGCAGATCTCGTGTAACGCCGATCACGCTATTGGAAGTCAGTCAGCCGGATTAGATACCCTAGTAGTC
(SEQ ID NO: 475) CCTACGGGAGGCATCAGGCAGATCTCGAGCAGAACATCTAACTTCACTTCCAGTCAGTCAGCCGGATTAGATACCCTAGTAGTC
(SEQ ID NO: 476) CCTACGGGAGGCATCAGGCAGATCTCGTGGAGTAGGTGGCCAGTGGATATAAGTCAGTCAGCCGGATTAGATACCCTAGTAGTC
(SEQ ID NO: 477) CCTACGGGAGGCATCAGGCAGATCTCGTTGGCTCTATTCTGTGTGTAACGCAGTCAGTCAGCCGGATTAGATACCCTAGTAGTC
(SEQ ID NO: 478) CCTACGGGAGGCATCAGGCAGATCTCGGATCCCACGTACCCAATCGTGCAAAGTCAGTCAGCCGGATTAGATACCCTAGTAGTC
(SEQ ID NO: 479) CCTACGGGAGGCATCAGGCAGATCTCGTACCGCTTCTTCAGGCTAGCAGAGAGTCAGTCAGCCGGATTAGATACCCTAGTAGTC TABLE 3-continued

| | full sequence |
|---|---|
| (SEQ ID NO: 480) | CCTACGGGAGGCATCAGGCAGATCTCGTGTGCGATAACAGTCACTCCGAACAGTCAGTCAGCCGGATTAGATACCCTAGTAGTC |
| (SEQ ID NO: 481) | CCTACGGGAGGCATCAGGCAGATCTCGGATTATCGACGACACCGAAATCTGAGTCAGTCAGCCGGATTAGATACCCTAGTAGTC |
| (SEQ ID NO: 482) | CCTACGGGAGGCATCAGGCAGATCTCGGCCTAGCCCAATTGACGTAGAACTAGTCAGTCAGCCGGATTAGATACCCTAGTAGTC |
| (SEQ ID NO: 483) | CCTACGGGAGGCATCAGGCAGATCTCGGATGTATGTGGTCTATGCCGGCTAAGTCAGTCAGCCGGATTAGATACCCTAGTAGTC |
| (SEQ ID NO: 484) | CCTACGGGAGGCATCAGGCAGATCTCGACTCCTTGTGTTGTGGTATGGGAGAGTCAGTCAGCCGGATTAGATACCCTAGTAGTC |
| (SEQ ID NO: 485) | CCTACGGGAGGCATCAGGCAGATCTCGGTCACGGACATTTGTACCAACCGAAGTCAGTCAGCCGGATTAGATACCCTAGTAGTC |
| (SEQ ID NO: 486) | CCTACGGGAGGCATCAGGCAGATCTCGGCGAGCGAAGTAAGGGTACAGGGTAGTCAGTCAGCCGGATTAGATACCCTAGTAGTC |
| (SEQ ID NO: 487) | CCTACGGGAGGCATCAGGCAGATCTCGATCTACCGAAGCAGAGTGCTAATCAGTCAGTCAGCCGGATTAGATACCCTAGTAGTC |
| (SEQ ID NO: 488) | CCTACGGGAGGCATCAGGCAGATCTCGACTTGGTGTAAGTTGGCGGGTTATAGTCAGTCAGCCGGATTAGATACCCTAGTAGTC |
| (SEQ ID NO: 489) | CCTACGGGAGGCATCAGGCAGATCTCGTCTTGGAGGTCACACGATGGTCATAGTCAGTCAGCCGGATTAGATACCCTAGTAGTC |
| (SEQ ID NO: 490) | CCTACGGGAGGCATCAGGCAGATCTCGTCACCTCCTTGTGTCACCAATCCGAGTCAGTCAGCCGGATTAGATACCCTAGTAGTC |
| (SEQ ID NO: 491) | CCTACGGGAGGCATCAGGCAGATCTCGGCACACCTGATACACTAACAAACGAGTCAGTCAGCCGGATTAGATACCCTAGTAGTC |
| (SEQ ID NO: 492) | CCTACGGGAGGCATCAGGCAGATCTCGGCGACAATTACATTCCAGGCAGATAGTCAGTCAGCCGGATTAGATACCCTAGTAGTC |
| (SEQ ID NO: 493) | CCTACGGGAGGCATCAGGCAGATCTCGTCATGCTCCATTTATGGTACCCAGAGTCAGTCAGCCGGATTAGATACCCTAGTAGTC |
| (SEQ ID NO: 494) | CCTACGGGAGGCATCAGGCAGATCTCGAGCTGTCAAGCTCACGACTTGACAAGTCAGTCAGCCGGATTAGATACCCTAGTAGTC |
| (SEQ ID NO: 495) | CCTACGGGAGGCATCAGGCAGATCTCGGAGAGCAACAGACTTGGAGGCTTAAGTCAGTCAGCCGGATTAGATACCCTAGTAGTC |
| (SEQ ID NO: 496) | CCTACGGGAGGCATCAGGCAGATCTCGTACTCGGGAACTACGTGGTTCCACAGTCAGTCAGCCGGATTAGATACCCTAGTAGTC |
| (SEQ ID NO: 497) | CCTACGGGAGGCATCAGGCAGATCTCGCGTGCTTAGGCTGACGCTTTGCTGAGTCAGTCAGCCGGATTAGATACCCTAGTAGTC |
| (SEQ ID NO: 498) | CCTACGGGAGGCATCAGGCAGATCTCGTACCGAAGGTATACAGGGTTTGTAAGTCAGTCAGCCGGATTAGATACCCTAGTAGTC |
| (SEQ ID NO: 499) | CCTACGGGAGGCATCAGGCAGATCTCGCACTCATCATTCGCCTATGAGATCAGTCAGTCAGCCGGATTAGATACCCTAGTAGTC |
| (SEQ ID NO: 500) | CCTACGGGAGGCATCAGGCAGATCTCGGTATTTCGGACGCAAACCTATGGCAGTCAGTCAGCCGGATTAGATACCCTAGTAGTC |
| (SEQ ID NO: 501) | CCTACGGGAGGCATCAGGCAGATCTCGTATCTATCCTGCATCGCTTAAGGCAGTCAGTCAGCCGGATTAGATACCCTAGTAGTC |
| (SEQ ID NO: 502) | CCTACGGGAGGCATCAGGCAGATCTCGTTGCCAAGAGTCACCATCCAACGAAGTCAGTCAGCCGGATTAGATACCCTAGTAGTC |
| (SEQ ID NO: 503) | CCTACGGGAGGCATCAGGCAGATCTCGAGTAGCGGAAGAGCAATAGGAGGAAGTCAGTCAGCCGGATTAGATACCCTAGTAGTC |
| (SEQ ID NO: 504) | CCTACGGGAGGCATCAGGCAGATCTCGGCAATTAGGTACCCGAACGTCACTAGTCAGTCAGCCGGATTAGATACCCTAGTAGTC |
| (SEQ ID NO: 505) | CCTACGGGAGGCATCAGGCAGATCTCGCATACCGTGAGTACACCAACACCAAGTCAGTCAGCCGGATTAGATACCCTAGTAGTC |
| (SEQ ID NO: 506) | CCTACGGGAGGCATCAGGCAGATCTCGATGTGTGTAGACCCATCACATAGGAGTCAGTCAGCCGGATTAGATACCCTAGTAGTC |
| (SEQ ID NO: 507) | CCTACGGGAGGCATCAGGCAGATCTCGCCTGCGAAGTATCGACACGGAGAAAGTCAGTCAGCCGGATTAGATACCCTAGTAGTC |
| (SEQ ID NO: 508) | CCTACGGGAGGCATCAGGCAGATCTCGTTCTCTCGACATGAACCTATGACAAGTCAGTCAGCCGGATTAGATACCCTAGTAGTC |
| (SEQ ID NO: 509) | CCTACGGGAGGCATCAGGCAGATCTCGGCTCTCCGTAGAATGCCGGTAATAAGTCAGTCAGCCGGATTAGATACCCTAGTAGTC |
| (SEQ ID NO: 510) | CCTACGGGAGGCATCAGGCAGATCTCGGTTAAGCTGACCGAACAGCTCTACAGTCAGTCAGCCGGATTAGATACCCTAGTAGTC |
| (SEQ ID NO: 511) | CCTACGGGAGGCATCAGGCAGATCTCGATGCCATGCCGTGTGAGTCATACCAGTCAGTCAGCCGGATTAGATACCCTAGTAGTC |
| (SEQ ID NO: 512) | CCTACGGGAGGCATCAGGCAGATCTCGGACATTGTCACGTGGCCGTTACTGAGTCAGTCAGCCGGATTAGATACCCTAGTAGTC |
| (SEQ ID NO: 513) | CCTACGGGAGGCATCAGGCAGATCTCGGCCAACAACCATTAGAGCTGCCATAGTCAGTCAGCCGGATTAGATACCCTAGTAGTC |
| (SEQ ID NO: 514) | CCTACGGGAGGCATCAGGCAGATCTCGATCAGTACTAGGATCTAGTGGCAAAGTCAGTCAGCCGGATTAGATACCCTAGTAGTC |
| (SEQ ID NO: 515) | CCTACGGGAGGCATCAGGCAGATCTCGTCCTCGAGCGATCCTTCAATGGGAAGTCAGTCAGCCGGATTAGATACCCTAGTAGTC |
| (SEQ ID NO: 516) | CCTACGGGAGGCATCAGGCAGATCTCGACCCAAGCGTTATTGACGACATCGAGTCAGTCAGCCGGATTAGATACCCTAGTAGTC |
| (SEQ ID NO: 517) | CCTACGGGAGGCATCAGGCAGATCTCGTGCAGCAAGATTACATACTGAGCAAGTCAGTCAGCCGGATTAGATACCCTAGTAGTC |
| (SEQ ID NO: 518) | CCTACGGGAGGCATCAGGCAGATCTCGAGCAACATTGCAGGCTAAACTATGAGTCAGTCAGCCGGATTAGATACCCTAGTAGTC |

TABLE 3-continued full sequence

| | |
|---|---|
| (SEQ ID NO: 519) | CCTACGGGAGGCATCAGGCAGATCTCGGATGTGGTGTTAAAGAGCAGAGCCAGTCAGTCAGCCGGATTAGATACCCTAGTAGTC |
| (SEQ ID NO: 520) | CCTACGGGAGGCATCAGGCAGATCTCGCAGAAATGTGTCGGAGAGATCACGAGTCAGTCAGCCGGATTAGATACCCTAGTAGTC |
| (SEQ ID NO: 521) | CCTACGGGAGGCATCAGGCAGATCTCGGTAGAGGTAGAGTCAACCCGTGAAAGTCAGTCAGCCGGATTAGATACCCTAGTAGTC |
| (SEQ ID NO: 522) | CCTACGGGAGGCATCAGGCAGATCTCGCGTGATCCGCTAGTTTGAAACACGAGTCAGTCAGCCGGATTAGATACCCTAGTAGTC |
| (SEQ ID NO: 523) | CCTACGGGAGGCATCAGGCAGATCTCGGGTTATTTGGCGAGAGAGACAGGTAGTCAGTCAGCCGGATTAGATACCCTAGTAGTC |
| (SEQ ID NO: 524) | CCTACGGGAGGCATCAGGCAGATCTCGGGATCGTAATACTCGCCAGTGCATAGTCAGTCAGCCGGATTAGATACCCTAGTAGTC |
| (SEQ ID NO: 525) | CCTACGGGAGGCATCAGGCAGATCTCGGCATAGCATCAAGCTCAGGACTCTAGTCAGTCAGCCGGATTAGATACCCTAGTAGTC |
| (SEQ ID NO: 526) | CCTACGGGAGGCATCAGGCAGATCTCGGTGTTAGATGTGCACTTTGGGTGCAGTCAGTCAGCCGGATTAGATACCCTAGTAGTC |
| (SEQ ID NO: 527) | CCTACGGGAGGCATCAGGCAGATCTCGTTAGAGCCATGCTCTAGCCTGGCAAGTCAGTCAGCCGGATTAGATACCCTAGTAGTC |
| (SEQ ID NO: 528) | CCTACGGGAGGCATCAGGCAGATCTCGTGAACCCTATGGAATGCAATGCGTAGTCAGTCAGCCGGATTAGATACCCTAGTAGTC |
| (SEQ ID NO: 529) | CCTACGGGAGGCATCAGGCAGATCTCGAGAGTCTTGCCACGAATGAGTCATAGTCAGTCAGCCGGATTAGATACCCTAGTAGTC |
| (SEQ ID NO: 530) | CCTACGGGAGGCATCAGGCAGATCTCGACAACACTCCGACAACGCTAGAATAGTCAGTCAGCCGGATTAGATACCCTAGTAGTC |
| (SEQ ID NO: 531) | CCTACGGGAGGCATCAGGCAGATCTCGCGATGCTGTTGAATCAGAGCCCATAGTCAGTCAGCCGGATTAGATACCCTAGTAGTC |
| (SEQ ID NO: 532) | CCTACGGGAGGCATCAGGCAGATCTCGACGACTGCATAATCTGTAGAGCCAAGTCAGTCAGCCGGATTAGATACCCTAGTAGTC |
| (SEQ ID NO: 533) | CCTACGGGAGGCATCAGGCAGATCTCGACGCGAACTAATCCGACTCTAGGTAGTCAGTCAGCCGGATTAGATACCCTAGTAGTC |
| (SEQ ID NO: 534) | CCTACGGGAGGCATCAGGCAGATCTCGAGCTATGTATGGATCCTACGAGCAAGTCAGTCAGCCGGATTAGATACCCTAGTAGTC |
| (SEQ ID NO: 535) | CCTACGGGAGGCATCAGGCAGATCTCGACGGGTCATCATGACAACGAATCTAGTCAGTCAGCCGGATTAGATACCCTAGTAGTC |
| (SEQ ID NO: 536) | CCTACGGGAGGCATCAGGCAGATCTCGGAAACATCCCACTGCGGTTGACTCAGTCAGTCAGCCGGATTAGATACCCTAGTAGTC |
| (SEQ ID NO: 537) | CCTACGGGAGGCATCAGGCAGATCTCGCGTACTCTCGAGTGAGAAGAAAGGAGTCAGTCAGCCGGATTAGATACCCTAGTAGTC |
| (SEQ ID NO: 538) | CCTACGGGAGGCATCAGGCAGATCTCGTCAGTTCTCGTTTCGGATCTGTGAAGTCAGTCAGCCGGATTAGATACCCTAGTAGTC |
| (SEQ ID NO: 539) | CCTACGGGAGGCATCAGGCAGATCTCGTCGTGCGTGTTGGCCGGTACTCTAAGTCAGTCAGCCGGATTAGATACCCTAGTAGTC |
| (SEQ ID NO: 540) | CCTACGGGAGGCATCAGGCAGATCTCGGTTATCGCATGGCACAGGATTACCAGTCAGTCAGCCGGATTAGATACCCTAGTAGTC |
| (SEQ ID NO: 541) | CCTACGGGAGGCATCAGGCAGATCTCGGATCACGAGAGGCGATATCAGTAGAGTCAGTCAGCCGGATTAGATACCCTAGTAGTC |
| (SEQ ID NO: 542) | CCTACGGGAGGCATCAGGCAGATCTCGGTAAATTCAGGCCATAAGGGAGGCAGTCAGTCAGCCGGATTAGATACCCTAGTAGTC |
| (SEQ ID NO: 543) | CCTACGGGAGGCATCAGGCAGATCTCGAGTGTTTCGGACTGTGTTACTCCTAGTCAGTCAGCCGGATTAGATACCCTAGTAGTC |
| (SEQ ID NO: 544) | CCTACGGGAGGCATCAGGCAGATCTCGACACGCGGTTTAGGTACCTGCAATAGTCAGTCAGCCGGATTAGATACCCTAGTAGTC |
| (SEQ ID NO: 545) | CCTACGGGAGGCATCAGGCAGATCTCGTGGCAAATCTAGTCGCCTATAAGGAGTCAGTCAGCCGGATTAGATACCCTAGTAGTC |
| (SEQ ID NO: 546) | CCTACGGGAGGCATCAGGCAGATCTCGCACCTTACCTTAAGTGGCACTATCAGTCAGTCAGCCGGATTAGATACCCTAGTAGTC |
| (SEQ ID NO: 547) | CCTACGGGAGGCATCAGGCAGATCTCGTTAACCTTCCTGTAACCCGATAGAAGTCAGTCAGCCGGATTAGATACCCTAGTAGTC |
| (SEQ ID NO: 548) | CCTACGGGAGGCATCAGGCAGATCTCGTGCCGTATGCCAGTGTGCTAACGTAGTCAGTCAGCCGGATTAGATACCCTAGTAGTC |
| (SEQ ID NO: 549) | CCTACGGGAGGCATCAGGCAGATCTCGCGTGACAATAGTCTTGCGGCAATCAGTCAGTCAGCCGGATTAGATACCCTAGTAGTC |
| (SEQ ID NO: 550) | CCTACGGGAGGCATCAGGCAGATCTCGCGCTACAACTCGTGAGGTTTGATGAGTCAGTCAGCCGGATTAGATACCCTAGTAGTC |
| (SEQ ID NO: 551) | CCTACGGGAGGCATCAGGCAGATCTCGTTAAGACAGTCGATTGCTGGTCGAAGTCAGTCAGCCGGATTAGATACCCTAGTAGTC |
| (SEQ ID NO: 552) | CCTACGGGAGGCATCAGGCAGATCTCGTCTGCACTGAGCAAGAAGCCGGACAGTCAGTCAGCCGGATTAGATACCCTAGTAGTC |
| (SEQ ID NO: 553) | CCTACGGGAGGCATCAGGCAGATCTCGCGCAGATTAGTAACGGGATACAGGAGTCAGTCAGCCGGATTAGATACCCTAGTAGTC |
| (SEQ ID NO: 554) | CCTACGGGAGGCATCAGGCAGATCTCGTGGGTCCCACATAAGAGTCTCTAGAGTCAGTCAGCCGGATTAGATACCCTAGTAGTC |
| (SEQ ID NO: 555) | CCTACGGGAGGCATCAGGCAGATCTCGCACTGGTGCATATCCGTCATGGGTAGTCAGTCAGCCGGATTAGATACCCTAGTAGTC |
| (SEQ ID NO: 556) | CCTACGGGAGGCATCAGGCAGATCTCGAACGTAGGCTCTAGATCTATGCAGAGTCAGTCAGCCGGATTAGATACCCTAGTAGTC |
| (SEQ ID NO: 557) | CCTACGGGAGGCATCAGGCAGATCTCGAGTTGTAGTCCGGCACAAGGCAAGAGTCAGTCAGCCGGATTAGATACCCTAGTAGTC |

TABLE 3-continued

| | full sequence |
|---|---|
| (SEQ ID NO: 558) | CCTACGGGAGGCATCAGGCAGATCTCGTCGTCAAACCCGCGGCAAACACTTAGTCAGTCAGCCGGATTAGATACCCTAGTAGTC |
| (SEQ ID NO: 559) | CCTACGGGAGGCATCAGGCAGATCTCGTAATCGGTGCCAGCGAGTTCCTGTAGTCAGTCAGCCGGATTAGATACCCTAGTAGTC |
| (SEQ ID NO: 560) | CCTACGGGAGGCATCAGGCAGATCTCGTTGATCCGGTAGTTCCGAATCGGCAGTCAGTCAGCCGGATTAGATACCCTAGTAGTC |
| (SEQ ID NO: 561) | CCTACGGGAGGCATCAGGCAGATCTCGCGGGTGTTTGCTTACCTAGTGAGAAGTCAGTCAGCCGGATTAGATACCCTAGTAGTC |
| (SEQ ID NO: 562) | CCTACGGGAGGCATCAGGCAGATCTCGTTGACCGCGGTTCGTTCTGGTGGTAGTCAGTCAGCCGGATTAGATACCCTAGTAGTC |
| (SEQ ID NO: 563) | CCTACGGGAGGCATCAGGCAGATCTCGGTGCAACCAATCTTGGTCTCCTCTAGTCAGTCAGCCGGATTAGATACCCTAGTAGTC |
| (SEQ ID NO: 564) | CCTACGGGAGGCATCAGGCAGATCTCGGCTTGAGCTTGACTGCATACTGAGAGTCAGTCAGCCGGATTAGATACCCTAGTAGTC |
| (SEQ ID NO: 565) | CCTACGGGAGGCATCAGGCAGATCTCGCGCTGTGGATTACAGGGCCTTTGTAGTCAGTCAGCCGGATTAGATACCCTAGTAGTC |
| (SEQ ID NO: 566) | CCTACGGGAGGCATCAGGCAGATCTCGCTGTCAGTGACCCGATGAATATCGAGTCAGTCAGCCGGATTAGATACCCTAGTAGTC |
| (SEQ ID NO: 567) | CCTACGGGAGGCATCAGGCAGATCTCGACGATTCGAGTCGTCAATTAGTGGAGTCAGTCAGCCGGATTAGATACCCTAGTAGTC |
| (SEQ ID NO: 568) | CCTACGGGAGGCATCAGGCAGATCTCGGGTTCGGTCCATAGTACGCAGTCTAGTCAGTCAGCCGGATTAGATACCCTAGTAGTC |
| (SEQ ID NO: 569) | CCTACGGGAGGCATCAGGCAGATCTCGCTGATCCATCTTAGCAGCTATTGCAGTCAGTCAGCCGGATTAGATACCCTAGTAGTC |
| (SEQ ID NO: 570) | CCTACGGGAGGCATCAGGCAGATCTCGTATGTGCCGGCTCTCGGATAGATCAGTCAGTCAGCCGGATTAGATACCCTAGTAGTC |
| (SEQ ID NO: 571) | CCTACGGGAGGCATCAGGCAGATCTCGTGGTCGCATCGTTTCCCGAAACGAAGTCAGTCAGCCGGATTAGATACCCTAGTAGTC |
| (SEQ ID NO: 572) | CCTACGGGAGGCATCAGGCAGATCTCGTGTAAGACTTGGGAACTTTAGCGCAGTCAGTCAGCCGGATTAGATACCCTAGTAGTC |
| (SEQ ID NO: 573) | CCTACGGGAGGCATCAGGCAGATCTCGCGGATCTAGTGTTCCTTAGAAGGCAGTCAGTCAGCCGGATTAGATACCCTAGTAGTC |
| (SEQ ID NO: 574) | CCTACGGGAGGCATCAGGCAGATCTCGCGATCTTCGAGCGATGGACTTCAAAGTCAGTCAGCCGGATTAGATACCCTAGTAGTC |
| (SEQ ID NO: 575) | CCTACGGGAGGCATCAGGCAGATCTCGGTCGAATTTGCGTACTGAGCCTCGAGTCAGTCAGCCGGATTAGATACCCTAGTAGTC |
| (SEQ ID NO: 576) | CCTACGGGAGGCATCAGGCAGATCTCGGCATCAGAGTTAAGAAGGCCTTATAGTCAGTCAGCCGGATTAGATACCCTAGTAGTC |
| (SEQ ID NO: 577) | CCTACGGGAGGCATCAGGCAGATCTCGGTGGTCATCGTATGGAGCCTTGTCAGTCAGTCAGCCGGATTAGATACCCTAGTAGTC |
| (SEQ ID NO: 578) | CCTACGGGAGGCATCAGGCAGATCTCGCTGAAGGGCGAACTCGATGTAAGCAGTCAGTCAGCCGGATTAGATACCCTAGTAGTC |
| (SEQ ID NO: 579) | CCTACGGGAGGCATCAGGCAGATCTCGCGCTCACAGAATAGCTTCGACAGTAGTCAGTCAGCCGGATTAGATACCCTAGTAGTC |
| (SEQ ID NO: 580) | CCTACGGGAGGCATCAGGCAGATCTCGATTCGGTAGTGCATACGCATCAAGAGTCAGTCAGCCGGATTAGATACCCTAGTAGTC |
| (SEQ ID NO: 581) | CCTACGGGAGGCATCAGGCAGATCTCGCGAGCTGTTACCAGATGTCCGTCAAGTCAGTCAGCCGGATTAGATACCCTAGTAGTC |
| (SEQ ID NO: 582) | CCTACGGGAGGCATCAGGCAGATCTCGCAACACATGCTGGCACCTGTTGAAAGTCAGTCAGCCGGATTAGATACCCTAGTAGTC |
| (SEQ ID NO: 583) | CCTACGGGAGGCATCAGGCAGATCTCGATTCTCTCACGTCCTAGAGAAACTAGTCAGTCAGCCGGATTAGATACCCTAGTAGTC |
| (SEQ ID NO: 584) | CCTACGGGAGGCATCAGGCAGATCTCGCGACTCTAAACGGAGGTTCTTGACAGTCAGTCAGCCGGATTAGATACCCTAGTAGTC |
| (SEQ ID NO: 585) | CCTACGGGAGGCATCAGGCAGATCTCGGTCTTCAGCAAGCTGTAAAGGTTGAGTCAGTCAGCCGGATTAGATACCCTAGTAGTC |
| (SEQ ID NO: 586) | CCTACGGGAGGCATCAGGCAGATCTCGCGGATAACCTCCTGAGTCATTGAGAGTCAGTCAGCCGGATTAGATACCCTAGTAGTC |
| (SEQ ID NO: 587) | CCTACGGGAGGCATCAGGCAGATCTCGAGGGTGACTTTATACGGCAGTTCAAGTCAGTCAGCCGGATTAGATACCCTAGTAGTC |
| (SEQ ID NO: 588) | CCTACGGGAGGCATCAGGCAGATCTCGGACTTCATGCGACTCTAGAAGAGTAGTCAGTCAGCCGGATTAGATACCCTAGTAGTC |
| (SEQ ID NO: 589) | CCTACGGGAGGCATCAGGCAGATCTCGGCCTGTCTGCAATGCACAGTCGCTAGTCAGTCAGCCGGATTAGATACCCTAGTAGTC |
| (SEQ ID NO: 590) | CCTACGGGAGGCATCAGGCAGATCTCGACTGATGGCCTCCATGCGGATCCTAGTCAGTCAGCCGGATTAGATACCCTAGTAGTC |
| (SEQ ID NO: 591) | CCTACGGGAGGCATCAGGCAGATCTCGTTCGATGCCGCATGCTCCGTAGAAAGTCAGTCAGCCGGATTAGATACCCTAGTAGTC |
| (SEQ ID NO: 592) | CCTACGGGAGGCATCAGGCAGATCTCGTGTGGCTCGTGTTGATAGGTACACAGTCAGTCAGCCGGATTAGATACCCTAGTAGTC |
| (SEQ ID NO: 593) | CCTACGGGAGGCATCAGGCAGATCTCGAACTTTCAGGAGCGAGTTCATCGAAGTCAGTCAGCCGGATTAGATACCCTAGTAGTC |
| (SEQ ID NO: 594) | CCTACGGGAGGCATCAGGCAGATCTCGTGCACGTGATAAAAGCAGATTGTCAGTCAGCCGGATTAGATACCCTAGTAGTC |
| (SEQ ID NO: 595) | CCTACGGGAGGCATCAGGCAGATCTCGGTTCGGTGTCCATAGAGGCGTAGGAGTCAGTCAGCCGGATTAGATACCCTAGTAGTC |
| (SEQ ID NO: 596) | CCTACGGGAGGCATCAGGCAGATCTCGAAGACAGCTATCTCAGCGCCGTTAAGTCAGTCAGCCGGATTAGATACCCTAGTAGTC |

TABLE 3-continued

| | full sequence |
|---|---|
| (SEQ ID NO: 597) | CCTACGGGAGGCATCAGGCAGATCTCGATTGACCGGTCATAGACCGACTCCAGTCAGTCAGCCGGATTAGATACCCTAGTAGTC |
| (SEQ ID NO: 598) | CCTACGGGAGGCATCAGGCAGATCTCGTTCTCCATCACAGTCAACGCTGTCAGTCAGTCAGCCGGATTAGATACCCTAGTAGTC |
| (SEQ ID NO: 599) | CCTACGGGAGGCATCAGGCAGATCTCGCGTAGGTAGAGGACAGGAGGGTGTAGTCAGTCAGCCGGATTAGATACCCTAGTAGTC |
| (SEQ ID NO: 600) | CCTACGGGAGGCATCAGGCAGATCTCGATTTAGGACGACGCTGTCGTCAACAGTCAGTCAGCCGGATTAGATACCCTAGTAGTC |
| (SEQ ID NO: 601) | CCTACGGGAGGCATCAGGCAGATCTCGGGATAGCCAAGGATAGAGGCCATTAGTCAGTCAGCCGGATTAGATACCCTAGTAGTC |
| (SEQ ID NO: 602) | CCTACGGGAGGCATCAGGCAGATCTCGTGGTTGGTTACGAAGCTTGAAACCAGTCAGTCAGCCGGATTAGATACCCTAGTAGTC |
| (SEQ ID NO: 603) | CCTACGGGAGGCATCAGGCAGATCTCGGTCGTCCAAATGTAAGCGTCTCGAAGTCAGTCAGCCGGATTAGATACCCTAGTAGTC |
| (SEQ ID NO: 604) | CCTACGGGAGGCATCAGGCAGATCTCGCAACGTGCTCCAATAGCTTCGTGGAGTCAGTCAGCCGGATTAGATACCCTAGTAGTC |
| (SEQ ID NO: 605) | CCTACGGGAGGCATCAGGCAGATCTCGTACACAAGTCGCCGGGATCAAATTAGTCAGTCAGCCGGATTAGATACCCTAGTAGTC |
| (SEQ ID NO: 606) | CCTACGGGAGGCATCAGGCAGATCTCGGCGTCCATGAATAGTCATCGAATGAGTCAGTCAGCCGGATTAGATACCCTAGTAGTC |
| (SEQ ID NO: 607) | CCTACGGGAGGCATCAGGCAGATCTCGGTAATGCGTAACATCTTGGAGTCGAGTCAGTCAGCCGGATTAGATACCCTAGTAGTC |
| (SEQ ID NO: 608) | CCTACGGGAGGCATCAGGCAGATCTCGGTCGCCGTACATAGCACCGGTCTTAGTCAGTCAGCCGGATTAGATACCCTAGTAGTC |
| (SEQ ID NO: 609) | CCTACGGGAGGCATCAGGCAGATCTCGGGAATCCGATTAGCAAATCAGCCTAGTCAGTCAGCCGGATTAGATACCCTAGTAGTC |
| (SEQ ID NO: 610) | CCTACGGGAGGCATCAGGCAGATCTCGCACCCGATGGTTGCAAGCTGTCTCAGTCAGTCAGCCGGATTAGATACCCTAGTAGTC |
| (SEQ ID NO: 611) | CCTACGGGAGGCATCAGGCAGATCTCGTTCTGAGAGGTAAGCGGCCTATTAAGTCAGTCAGCCGGATTAGATACCCTAGTAGTC |
| (SEQ ID NO: 612) | CCTACGGGAGGCATCAGGCAGATCTCGATCCCTACGGAATCTTCAACTACCAGTCAGTCAGCCGGATTAGATACCCTAGTAGTC |
| (SEQ ID NO: 613) | CCTACGGGAGGCATCAGGCAGATCTCGGGTTCCATTAGGTGGAATTCGGCTAGTCAGTCAGCCGGATTAGATACCCTAGTAGTC |
| (SEQ ID NO: 614) | CCTACGGGAGGCATCAGGCAGATCTCGGTGTTCCCAGAATAAGATGCAGTCAGTCAGTCAGCCGGATTAGATACCCTAGTAGTC |
| (SEQ ID NO: 615) | CCTACGGGAGGCATCAGGCAGATCTCGCCGAGGTATAATTGCCGAGTAATCAGTCAGTCAGCCGGATTAGATACCCTAGTAGTC |
| (SEQ ID NO: 616) | CCTACGGGAGGCATCAGGCAGATCTCGAGCGTAATTAGCACCTTGACAAGAAGTCAGTCAGCCGGATTAGATACCCTAGTAGTC |
| (SEQ ID NO: 617) | CCTACGGGAGGCATCAGGCAGATCTCGCTCGTGAATGACGTAACCACCACCAGTCAGTCAGCCGGATTAGATACCCTAGTAGTC |
| (SEQ ID NO: 618) | CCTACGGGAGGCATCAGGCAGATCTCGAGGTGAGTTCTACATAGCTCGGTCAGTCAGTCAGCCGGATTAGATACCCTAGTAGTC |
| (SEQ ID NO: 619) | CCTACGGGAGGCATCAGGCAGATCTCGCCTGTCCTATCTAACCATGCCAACAGTCAGTCAGCCGGATTAGATACCCTAGTAGTC |
| (SEQ ID NO: 620) | CCTACGGGAGGCATCAGGCAGATCTCGGGTTTAACACGCTATGGAGCTAGTAGTCAGTCAGCCGGATTAGATACCCTAGTAGTC |
| (SEQ ID NO: 621) | CCTACGGGAGGCATCAGGCAGATCTCGAGACAGTAGGAGACTACCTCTTCAAGTCAGTCAGCCGGATTAGATACCCTAGTAGTC |
| (SEQ ID NO: 622) | CCTACGGGAGGCATCAGGCAGATCTCGGCCACGACTTACGATGATAACCCAAGTCAGTCAGCCGGATTAGATACCCTAGTAGTC |
| (SEQ ID NO: 623) | CCTACGGGAGGCATCAGGCAGATCTCGATTGTTCCTACCGGCCCAATATAAAGTCAGTCAGCCGGATTAGATACCCTAGTAGTC |
| (SEQ ID NO: 624) | CCTACGGGAGGCATCAGGCAGATCTCGGCCGTAAACTTGTTGTATGACAGGAGTCAGTCAGCCGGATTAGATACCCTAGTAGTC |
| (SEQ ID NO: 625) | CCTACGGGAGGCATCAGGCAGATCTCGGCAGATTTCCAGGGTAAGTTTGACAGTCAGTCAGCCGGATTAGATACCCTAGTAGTC |
| (SEQ ID NO: 626) | CCTACGGGAGGCATCAGGCAGATCTCGAGATGATCAGTCCTACCACGGTACAGTCAGTCAGCCGGATTAGATACCCTAGTAGTC |
| (SEQ ID NO: 627) | CCTACGGGAGGCATCAGGCAGATCTCGGAGACGTGTTCTCGGTCTGTCTGAAGTCAGTCAGCCGGATTAGATACCCTAGTAGTC |
| (SEQ ID NO: 628) | CCTACGGGAGGCATCAGGCAGATCTCGTATCACCGGACGTACATGTCGCCAGTCAGTCAGCCGGATTAGATACCCTAGTAGTC |
| (SEQ ID NO: 629) | CCTACGGGAGGCATCAGGCAGATCTCGTATGCCAGAGATTTCTAGAGTGCGAGTCAGTCAGCCGGATTAGATACCCTAGTAGTC |
| (SEQ ID NO: 630) | CCTACGGGAGGCATCAGGCAGATCTCGAGGTCCAAATCAACGGATGTTATGAGTCAGTCAGCCGGATTAGATACCCTAGTAGTC |
| (SEQ ID NO: 631) | CCTACGGGAGGCATCAGGCAGATCTCGACCGTGCTCACATTGAGGCTACAAAGTCAGTCAGCCGGATTAGATACCCTAGTAGTC |
| (SEQ ID NO: 632) | CCTACGGGAGGCATCAGGCAGATCTCGCTCCCTTTGTGTGTAGGAACCGGAAGTCAGTCAGCCGGATTAGATACCCTAGTAGTC |
| (SEQ ID NO: 633) | CCTACGGGAGGCATCAGGCAGATCTCGAGCTGCACCTAAACATCTAGCAGAAGTCAGTCAGCCGGATTAGATACCCTAGTAGTC |
| (SEQ ID NO: 634) | CCTACGGGAGGCATCAGGCAGATCTCGCCTTGACCGATGCCGACATTGAGAGTCAGTCAGCCGGATTAGATACCCTAGTAGTC |
| (SEQ ID NO: 635) | CCTACGGGAGGCATCAGGCAGATCTCGCTATCATCCTCACATGTAAGGCTCAGTCAGTCAGCCGGATTAGATACCCTAGTAGTC |

TABLE 3-continued

| | full sequence |
|---|---|
| (SEQ ID NO: 636) | CCTACGGGAGGCATCAGGCAGATCTCGACTCTAGCCGGTTGCAAGCTAAGTAGTCAGTCAGCCGGATTAGATACCCTAGTAGTC |
| (SEQ ID NO: 637) | CCTACGGGAGGCATCAGGCAGATCTCGCGATAGGCCTTAGTGTGTGCCATAAGTCAGTCAGCCGGATTAGATACCCTAGTAGTC |
| (SEQ ID NO: 638) | CCTACGGGAGGCATCAGGCAGATCTCGAATGACCTCGTGTGACAACCGAATAGTCAGTCAGCCGGATTAGATACCCTAGTAGTC |
| (SEQ ID NO: 639) | CCTACGGGAGGCATCAGGCAGATCTCGCTTAGGCATGTGTAGGCTCGTGCTAGTCAGTCAGCCGGATTAGATACCCTAGTAGTC |
| (SEQ ID NO: 640) | CCTACGGGAGGCATCAGGCAGATCTCGCCAGATATAGCACTCCTTAAGGCGAGTCAGTCAGCCGGATTAGATACCCTAGTAGTC |
| (SEQ ID NO: 641) | CCTACGGGAGGCATCAGGCAGATCTCGGAGAGTCCACTTTTGCCTGGGTCAAGTCAGTCAGCCGGATTAGATACCCTAGTAGTC |
| (SEQ ID NO: 642) | CCTACGGGAGGCATCAGGCAGATCTCGGAACGGGACGTACAATTCTGCTTCAGTCAGTCAGCCGGATTAGATACCCTAGTAGTC |
| (SEQ ID NO: 643) | CCTACGGGAGGCATCAGGCAGATCTCGACGTGTAGGCTTACTGGCAAACCTAGTCAGTCAGCCGGATTAGATACCCTAGTAGTC |
| (SEQ ID NO: 644) | CCTACGGGAGGCATCAGGCAGATCTCGGGTCTCCTACAGAATCAGAGCTTGAGTCAGTCAGCCGGATTAGATACCCTAGTAGTC |
| (SEQ ID NO: 645) | CCTACGGGAGGCATCAGGCAGATCTCGACTGACTTAAGGCAATGTAGACACAGTCAGTCAGCCGGATTAGATACCCTAGTAGTC |
| (SEQ ID NO: 646) | CCTACGGGAGGCATCAGGCAGATCTCGGATGCTGCCGTTTGGCGATACGTTAGTCAGTCAGCCGGATTAGATACCCTAGTAGTC |
| (SEQ ID NO: 647) | CCTACGGGAGGCATCAGGCAGATCTCGTTCCTAGGCCAGGCCTTACGATAGAGTCAGTCAGCCGGATTAGATACCCTAGTAGTC |
| (SEQ ID NO: 648) | CCTACGGGAGGCATCAGGCAGATCTCGATTAAGCCTGGATACCTGTGTCTTAGTCAGTCAGCCGGATTAGATACCCTAGTAGTC |
| (SEQ ID NO: 649) | CCTACGGGAGGCATCAGGCAGATCTCGTGGCTTTCTATCAACGAGGCAACGAGTCAGTCAGCCGGATTAGATACCCTAGTAGTC |
| (SEQ ID NO: 650) | CCTACGGGAGGCATCAGGCAGATCTCGACAGCTCAAACAGAAGACAGCGACAGTCAGTCAGCCGGATTAGATACCCTAGTAGTC |
| (SEQ ID NO: 651) | CCTACGGGAGGCATCAGGCAGATCTCGGAGCGTATCCATACACCTGCGATCAGTCAGTCAGCCGGATTAGATACCCTAGTAGTC |
| (SEQ ID NO: 652) | CCTACGGGAGGCATCAGGCAGATCTCGATGGGCGAATGGGCGTTGCATTCAGTCAGTCAGCCGGATTAGATACCCTAGTAGTC |
| (SEQ ID NO: 653) | CCTACGGGAGGCATCAGGCAGATCTCGGATCTCTGGGTAACTAGCGTTCAGAGTCAGTCAGCCGGATTAGATACCCTAGTAGTC |
| (SEQ ID NO: 654) | CCTACGGGAGGCATCAGGCAGATCTCGCATCATACGGGTTTGCGACAAAGTAGTCAGTCAGCCGGATTAGATACCCTAGTAGTC |
| (SEQ ID NO: 655) | CCTACGGGAGGCATCAGGCAGATCTCGTACGGATTATGGTGCGAGTATATGAGTCAGTCAGCCGGATTAGATACCCTAGTAGTC |
| (SEQ ID NO: 656) | CCTACGGGAGGCATCAGGCAGATCTCGATAGCGAACTCATACCACAACGAAAGTCAGTCAGCCGGATTAGATACCCTAGTAGTC |
| (SEQ ID NO: 657) | CCTACGGGAGGCATCAGGCAGATCTCGTAACGCTGTGTGTCTGGAACGGTTAGTCAGTCAGCCGGATTAGATACCCTAGTAGTC |
| (SEQ ID NO: 658) | CCTACGGGAGGCATCAGGCAGATCTCGAACCAAACTCGAGTACTACCTCGGAGTCAGTCAGCCGGATTAGATACCCTAGTAGTC |
| (SEQ ID NO: 659) | CCTACGGGAGGCATCAGGCAGATCTCGGCCGTCTCGTAATTCCTGTTAACCAGTCAGTCAGCCGGATTAGATACCCTAGTAGTC |
| (SEQ ID NO: 660) | CCTACGGGAGGCATCAGGCAGATCTCGCTGGGTATCTCGCTATCCAAGTGGAGTCAGTCAGCCGGATTAGATACCCTAGTAGTC |
| (SEQ ID NO: 661) | CCTACGGGAGGCATCAGGCAGATCTCGGACTACCCGTTGCAGTCTAGTACGAGTCAGTCAGCCGGATTAGATACCCTAGTAGTC |
| (SEQ ID NO: 662) | CCTACGGGAGGCATCAGGCAGATCTCGGCGTTGCAAACTGTGTCCGGATTCAGTCAGTCAGCCGGATTAGATACCCTAGTAGTC |
| (SEQ ID NO: 663) | CCTACGGGAGGCATCAGGCAGATCTCGAACCGCATAAGTTGTGGTGATGTAAGTCAGTCAGCCGGATTAGATACCCTAGTAGTC |
| (SEQ ID NO: 664) | CCTACGGGAGGCATCAGGCAGATCTCGACCTTACACCTTCTTTCGTTCAACAGTCAGTCAGCCGGATTAGATACCCTAGTAGTC |
| (SEQ ID NO: 665) | CCTACGGGAGGCATCAGGCAGATCTCGGTAGGTGCTTACCCGAAGATTCTGAGTCAGTCAGCCGGATTAGATACCCTAGTAGTC |
| (SEQ ID NO: 666) | CCTACGGGAGGCATCAGGCAGATCTCGCGCATTTGGATGGTTGGCGTTACAAGTCAGTCAGCCGGATTAGATACCCTAGTAGTC |
| (SEQ ID NO: 667) | CCTACGGGAGGCATCAGGCAGATCTCGATAACATGTGCGGAAGTAGCGAGCAGTCAGTCAGCCGGATTAGATACCCTAGTAGTC |
| (SEQ ID NO: 668) | CCTACGGGAGGCATCAGGCAGATCTCGCTTGAGAAATCGTTGCGGACCCTAAGTCAGTCAGCCGGATTAGATACCCTAGTAGTC |
| (SEQ ID NO: 669) | CCTACGGGAGGCATCAGGCAGATCTCGCTACACAGCACAGCGGAAACATGGAGTCAGTCAGCCGGATTAGATACCCTAGTAGTC |
| (SEQ ID NO: 670) | CCTACGGGAGGCATCAGGCAGATCTCGGAAATGCTACGTAACGTTAGTGTGAGTCAGTCAGCCGGATTAGATACCCTAGTAGTC |
| (SEQ ID NO: 671) | CCTACGGGAGGCATCAGGCAGATCTCGTCTGAGGTTGCCTGCATGACAGTCAGTCAGCCGGATTAGATACCCTAGTAGTC |
| (SEQ ID NO: 672) | CCTACGGGAGGCATCAGGCAGATCTCGGATCATTCTCTCTCAATCGCTTTCAGTCAGTCAGCCGGATTAGATACCCTAGTAGTC |
| (SEQ ID NO: 673) | CCTACGGGAGGCATCAGGCAGATCTCGAGACATACCGTACTACCGATTGCGAGTCAGTCAGCCGGATTAGATACCCTAGTAGTC |
| (SEQ ID NO: 674) | CCTACGGGAGGCATCAGGCAGATCTCGGATCCTCATGCGTCACCCAAGGTAAGTCAGTCAGCCGGATTAGATACCCTAGTAGTC |

TABLE 3-continued

| | full sequence |
|---|---|
| (SEQ ID NO: 675) | CCTACGGGAGGCATCAGGCAGATCTCGATTATCGTCCCTAGCCAGTCATACAGTCAGTCAGCCGGATTAGATACCCTAGTAGTC |
| (SEQ ID NO: 676) | CCTACGGGAGGCATCAGGCAGATCTCGCCAGACCGCTATTAACGGCGCTCTAGTCAGTCAGCCGGATTAGATACCCTAGTAGTC |
| (SEQ ID NO: 677) | CCTACGGGAGGCATCAGGCAGATCTCGAGCTCTAGAAACGTTTGCTCGAGAAGTCAGTCAGCCGGATTAGATACCCTAGTAGTC |
| (SEQ ID NO: 678) | CCTACGGGAGGCATCAGGCAGATCTCGTCCATCGACGTGCAAACGCACTAAAGTCAGTCAGCCGGATTAGATACCCTAGTAGTC |
| (SEQ ID NO: 679) | CCTACGGGAGGCATCAGGCAGATCTCGCGATGTGTGGTTGAACAAAGAGCGAGTCAGTCAGCCGGATTAGATACCCTAGTAGTC |
| (SEQ ID NO: 680) | CCTACGGGAGGCATCAGGCAGATCTCGGCGAAGTTGGGAGCTAAGTGATGTAGTCAGTCAGCCGGATTAGATACCCTAGTAGTC |
| (SEQ ID NO: 681) | CCTACGGGAGGCATCAGGCAGATCTCGGCATTCGGCGTTAAGGGACAAGTGAGTCAGTCAGCCGGATTAGATACCCTAGTAGTC |
| (SEQ ID NO: 682) | CCTACGGGAGGCATCAGGCAGATCTCGCGCCATTGTGCAAGTGTCGATTCGAGTCAGTCAGCCGGATTAGATACCCTAGTAGTC |
| (SEQ ID NO: 683) | CCTACGGGAGGCATCAGGCAGATCTCGTCCAACTGCAGACTATTAAGCGGCAGTCAGTCAGCCGGATTAGATACCCTAGTAGTC |
| (SEQ ID NO: 684) | CCTACGGGAGGCATCAGGCAGATCTCGTAAAGACCCGTACCTACCATTGTTAGTCAGTCAGCCGGATTAGATACCCTAGTAGTC |
| (SEQ ID NO: 685) | CCTACGGGAGGCATCAGGCAGATCTCGTGTATCTTCACCGAGTCCGTTGCTAGTCAGTCAGCCGGATTAGATACCCTAGTAGTC |
| (SEQ ID NO: 686) | CCTACGGGAGGCATCAGGCAGATCTCGGACTGACTCGTCGATAACTGTACGAGTCAGTCAGCCGGATTAGATACCCTAGTAGTC |
| (SEQ ID NO: 687) | CCTACGGGAGGCATCAGGCAGATCTCGTCGTGGATAGCTTAAACCTGGACAAGTCAGTCAGCCGGATTAGATACCCTAGTAGTC |
| (SEQ ID NO: 688) | CCTACGGGAGGCATCAGGCAGATCTCGGACGCACTAACTCCGAATTGACAAAGTCAGTCAGCCGGATTAGATACCCTAGTAGTC |
| (SEQ ID NO: 689) | CCTACGGGAGGCATCAGGCAGATCTCGGGCGATTTACGTCTGGCATCTAGCAGTCAGTCAGCCGGATTAGATACCCTAGTAGTC |
| (SEQ ID NO: 690) | CCTACGGGAGGCATCAGGCAGATCTCGTAAGGCATCGCTGGTGGTCGTTCTAGTCAGTCAGCCGGATTAGATACCCTAGTAGTC |
| (SEQ ID NO: 691) | CCTACGGGAGGCATCAGGCAGATCTCGACCCATACAGCCACTATGGGCTAAAGTCAGTCAGCCGGATTAGATACCCTAGTAGTC |
| (SEQ ID NO: 692) | CCTACGGGAGGCATCAGGCAGATCTCGCGCACTACGCATGCATTGAGTTCGAGTCAGTCAGCCGGATTAGATACCCTAGTAGTC |
| (SEQ ID NO: 693) | CCTACGGGAGGCATCAGGCAGATCTCGCAGTCGTTAAGAGTTGCTGAGTCCAGTCAGTCAGCCGGATTAGATACCCTAGTAGTC |
| (SEQ ID NO: 694) | CCTACGGGAGGCATCAGGCAGATCTCGCTACGAAAGCCTCTATGGTGAACCAGTCAGTCAGCCGGATTAGATACCCTAGTAGTC |
| (SEQ ID NO: 695) | CCTACGGGAGGCATCAGGCAGATCTCGATAATTGCCGAGGGACCAAGGGATAGTCAGTCAGCCGGATTAGATACCCTAGTAGTC |
| (SEQ ID NO: 696) | CCTACGGGAGGCATCAGGCAGATCTCGGGCATGTTATCGGTATTGGTCAGAAGTCAGTCAGCCGGATTAGATACCCTAGTAGTC |
| (SEQ ID NO: 697) | CCTACGGGAGGCATCAGGCAGATCTCGAGGCACAGTAGGAGAACCGTCATAAGTCAGTCAGCCGGATTAGATACCCTAGTAGTC |
| (SEQ ID NO: 698) | CCTACGGGAGGCATCAGGCAGATCTCGCTACTTACATCCAACTGGAACCCTAGTCAGTCAGCCGGATTAGATACCCTAGTAGTC |
| (SEQ ID NO: 699) | CCTACGGGAGGCATCAGGCAGATCTCGCTCTTCTGATCAATACTCGGCTGCAGTCAGTCAGCCGGATTAGATACCCTAGTAGTC |
| (SEQ ID NO: 700) | CCTACGGGAGGCATCAGGCAGATCTCGATGCTAACCACGACGCTTAACGACAGTCAGTCAGCCGGATTAGATACCCTAGTAGTC |
| (SEQ ID NO: 701) | CCTACGGGAGGCATCAGGCAGATCTCGACCAATCTCGGCAGCTTACCGACCAGTCAGTCAGCCGGATTAGATACCCTAGTAGTC |
| (SEQ ID NO: 702) | CCTACGGGAGGCATCAGGCAGATCTCGTATCCAAGCGCAAGGGCTATAGTTAGTCAGTCAGCCGGATTAGATACCCTAGTAGTC |
| (SEQ ID NO: 703) | CCTACGGGAGGCATCAGGCAGATCTCGGTACTGAAGATCTGTCTCGCAAGCAGTCAGTCAGCCGGATTAGATACCCTAGTAGTC |
| (SEQ ID NO: 704) | CCTACGGGAGGCATCAGGCAGATCTCGTCGCCGTGTACACAGCCGCATATCAGTCAGTCAGCCGGATTAGATACCCTAGTAGTC |
| (SEQ ID NO: 705) | CCTACGGGAGGCATCAGGCAGATCTCGAACTGCGATATGGATACGTTCGCAAGTCAGTCAGCCGGATTAGATACCCTAGTAGTC |
| (SEQ ID NO: 706) | CCTACGGGAGGCATCAGGCAGATCTCGCTTCCAACTCATCCAAGATTCGCCAGTCAGTCAGCCGGATTAGATACCCTAGTAGTC |
| (SEQ ID NO: 707) | CCTACGGGAGGCATCAGGCAGATCTCGGAGATCGCCTATGAGGCTGATTTAAGTCAGTCAGCCGGATTAGATACCCTAGTAGTC |
| (SEQ ID NO: 708) | CCTACGGGAGGCATCAGGCAGATCTCGTGTACATCGCCGGAGTTAGCATCAAGTCAGTCAGCCGGATTAGATACCCTAGTAGTC |
| (SEQ ID NO: 709) | CCTACGGGAGGCATCAGGCAGATCTCGTGTTAAGCAGCATGTAGTATAGGCAGTCAGTCAGCCGGATTAGATACCCTAGTAGTC |
| (SEQ ID NO: 710) | CCTACGGGAGGCATCAGGCAGATCTCGACGGCGTTATGTCTCACGCAATGCAGTCAGTCAGCCGGATTAGATACCCTAGTAGTC |
| (SEQ ID NO: 711) | CCTACGGGAGGCATCAGGCAGATCTCGACTTTGCTTTGCGTCCCGTGAAATAGTCAGTCAGCCGGATTAGATACCCTAGTAGTC |
| (SEQ ID NO: 712) | CCTACGGGAGGCATCAGGCAGATCTCGCAAAGCGGTATTGGACAGTGTATTAGTCAGTCAGCCGGATTAGATACCCTAGTAGTC |
| (SEQ ID NO: 713) | CCTACGGGAGGCATCAGGCAGATCTCGCGAAACTACGTAACACGACTATAGAGTCAGTCAGCCGGATTAGATACCCTAGTAGTC |

TABLE 3-continued

| | full sequence |
|---|---|
| (SEQ ID NO: 714) | CCTACGGGAGGCATCAGGCAGATCTCGGAGGACCAGCAAGTGTAGGTGCTTAGTCAGTCAGCCGGATTAGATACCCTAGTAGTC |
| (SEQ ID NO: 715) | CCTACGGGAGGCATCAGGCAGATCTCGAATAGCATGTCGTGAACTAGCGTCAGTCAGTCAGCCGGATTAGATACCCTAGTAGTC |
| (SEQ ID NO: 716) | CCTACGGGAGGCATCAGGCAGATCTCGCGGAGTAATCCTTCCGAGTCACCAAGTCAGTCAGCCGGATTAGATACCCTAGTAGTC |
| (SEQ ID NO: 717) | CCTACGGGAGGCATCAGGCAGATCTCGCTGTGTCCATGGTCCTCTTTGGTCAGTCAGTCAGCCGGATTAGATACCCTAGTAGTC |
| (SEQ ID NO: 718) | CCTACGGGAGGCATCAGGCAGATCTCGCTTCGCGGATGTTCCACCCTCTATAGTCAGTCAGCCGGATTAGATACCCTAGTAGTC |
| (SEQ ID NO: 719) | CCTACGGGAGGCATCAGGCAGATCTCGATAGGCTGTAGTTCGTGACGCTAAAGTCAGTCAGCCGGATTAGATACCCTAGTAGTC |
| (SEQ ID NO: 720) | CCTACGGGAGGCATCAGGCAGATCTCGTGTGTAGCCATGACGGCTAGTTCCAGTCAGTCAGCCGGATTAGATACCCTAGTAGTC |
| (SEQ ID NO: 721) | CCTACGGGAGGCATCAGGCAGATCTCGAAGGGCGCTGAAGCACTGGCATATAGTCAGTCAGCCGGATTAGATACCCTAGTAGTC |
| (SEQ ID NO: 722) | CCTACGGGAGGCATCAGGCAGATCTCGGTTTCCGTGGTGGGCATTAGTTGAAGTCAGTCAGCCGGATTAGATACCCTAGTAGTC |
| (SEQ ID NO: 723) | CCTACGGGAGGCATCAGGCAGATCTCGAGGAACCAGACGCGGTAGTTGATCAGTCAGTCAGCCGGATTAGATACCCTAGTAGTC |
| (SEQ ID NO: 724) | CCTACGGGAGGCATCAGGCAGATCTCGTAATGCCCAGGTTGAAAGCGGCGAAGTCAGTCAGCCGGATTAGATACCCTAGTAGTC |
| (SEQ ID NO: 725) | CCTACGGGAGGCATCAGGCAGATCTCGTATGAACGTCCGGGTTACGGTTACAGTCAGTCAGCCGGATTAGATACCCTAGTAGTC |
| (SEQ ID NO: 726) | CCTACGGGAGGCATCAGGCAGATCTCGCCACATTGGGTCACATCAGGTCACAGTCAGTCAGCCGGATTAGATACCCTAGTAGTC |
| (SEQ ID NO: 727) | CCTACGGGAGGCATCAGGCAGATCTCGTCAGTCAGATGAGTTGATACGATGAGTCAGTCAGCCGGATTAGATACCCTAGTAGTC |
| (SEQ ID NO: 728) | CCTACGGGAGGCATCAGGCAGATCTCGAAGTCACACACACAGACACTTCCGAGTCAGTCAGCCGGATTAGATACCCTAGTAGTC |
| (SEQ ID NO: 729) | CCTACGGGAGGCATCAGGCAGATCTCGGCTGTGATTCGATCACCATCCGAGAGTCAGTCAGCCGGATTAGATACCCTAGTAGTC |
| (SEQ ID NO: 730) | CCTACGGGAGGCATCAGGCAGATCTCGCTAGCTATGGACACCCACCACTAGAGTCAGTCAGCCGGATTAGATACCCTAGTAGTC |
| (SEQ ID NO: 731) | CCTACGGGAGGCATCAGGCAGATCTCGCTTGACGAGGTTCAGAAGGTGTGGAGTCAGTCAGCCGGATTAGATACCCTAGTAGTC |
| (SEQ ID NO: 732) | CCTACGGGAGGCATCAGGCAGATCTCGACCTGGGAATATGAAGCTTGAATCAGTCAGTCAGCCGGATTAGATACCCTAGTAGTC |
| (SEQ ID NO: 733) | CCTACGGGAGGCATCAGGCAGATCTCGCTCTGCCTAATTACTAGGATCAGTAGTCAGTCAGCCGGATTAGATACCCTAGTAGTC |
| (SEQ ID NO: 734) | CCTACGGGAGGCATCAGGCAGATCTCGATATGACCCAGCGCTCCTTAGAAGAGTCAGTCAGCCGGATTAGATACCCTAGTAGTC |
| (SEQ ID NO: 735) | CCTACGGGAGGCATCAGGCAGATCTCGCTCTATTCCACCTCCCATTCCCATAGTCAGTCAGCCGGATTAGATACCCTAGTAGTC |
| (SEQ ID NO: 736) | CCTACGGGAGGCATCAGGCAGATCTCGATTGAGTGAGTCTGGCGTCATTCGAGTCAGTCAGCCGGATTAGATACCCTAGTAGTC |
| (SEQ ID NO: 737) | CCTACGGGAGGCATCAGGCAGATCTCGTTATGGTACGGAAATCCTCGGAGTAGTCAGTCAGCCGGATTAGATACCCTAGTAGTC |
| (SEQ ID NO: 738) | CCTACGGGAGGCATCAGGCAGATCTCGGCTAGTTATGGACTGGACGCATTAAGTCAGTCAGCCGGATTAGATACCCTAGTAGTC |
| (SEQ ID NO: 739) | CCTACGGGAGGCATCAGGCAGATCTCGCAGATTAACCAGACCGATTAGGTAAGTCAGTCAGCCGGATTAGATACCCTAGTAGTC |
| (SEQ ID NO: 740) | CCTACGGGAGGCATCAGGCAGATCTCGGGCTGCATACTCATGTGCTGCTCGAGTCAGTCAGCCGGATTAGATACCCTAGTAGTC |
| (SEQ ID NO: 741) | CCTACGGGAGGCATCAGGCAGATCTCGTTGGTAAAGTGCTACGTACGAAACAGTCAGTCAGCCGGATTAGATACCCTAGTAGTC |
| (SEQ ID NO: 742) | CCTACGGGAGGCATCAGGCAGATCTCGAAGTGGCTATCCATCACATTCTCCAGTCAGTCAGCCGGATTAGATACCCTAGTAGTC |
| (SEQ ID NO: 743) | CCTACGGGAGGCATCAGGCAGATCTCGAACCGATGTACCAGCCTGGTACCTAGTCAGTCAGCCGGATTAGATACCCTAGTAGTC |
| (SEQ ID NO: 744) | CCTACGGGAGGCATCAGGCAGATCTCGTCGATTGGCCGTGCTAAAGTCGTAAGTCAGTCAGCCGGATTAGATACCCTAGTAGTC |
| (SEQ ID NO: 745) | CCTACGGGAGGCATCAGGCAGATCTCGGCATTACTGGACTCTCAGCGCGTAAGTCAGTCAGCCGGATTAGATACCCTAGTAGTC |
| (SEQ ID NO: 746) | CCTACGGGAGGCATCAGGCAGATCTCGTTGGGCCACATAGACCCTAGACCTAGTCAGTCAGCCGGATTAGATACCCTAGTAGTC |
| (SEQ ID NO: 747) | CCTACGGGAGGCATCAGGCAGATCTCGCACACAAAGTCATATTCAGCGGACAGTCAGTCAGCCGGATTAGATACCCTAGTAGTC |
| (SEQ ID NO: 748) | CCTACGGGAGGCATCAGGCAGATCTCGGCCAAGGATAGGGTTCCGGATTAGAGTCAGTCAGCCGGATTAGATACCCTAGTAGTC |
| (SEQ ID NO: 749) | CCTACGGGAGGCATCAGGCAGATCTCGCGCCACGTGTATGCGTGTAATTAGAGTCAGTCAGCCGGATTAGATACCCTAGTAGTC |
| (SEQ ID NO: 750) | CCTACGGGAGGCATCAGGCAGATCTCGGCAACCGATTGTCTGTAGCTTGGCAGTCAGTCAGCCGGATTAGATACCCTAGTAGTC |
| (SEQ ID NO: 751) | CCTACGGGAGGCATCAGGCAGATCTCGCATGTGCTTAGGATGCCTCGTAAGAGTCAGTCAGCCGGATTAGATACCCTAGTAGTC |
| (SEQ ID NO: 752) | CCTACGGGAGGCATCAGGCAGATCTCGGTTCCTCCATTAACCTATGGTGAAAGTCAGTCAGCCGGATTAGATACCCTAGTAGTC |

TABLE 3-continued full sequence

| | |
|---|---|
| (SEQ ID NO: 753) | CCTACGGGAGGCATCAGGCAGATCTCGACCTGTCCTTTCCTGTTACAGCGAAGTCAGTCAGCCGGATTAGATACCCTAGTAGTC |
| (SEQ ID NO: 754) | CCTACGGGAGGCATCAGGCAGATCTCGGTTCACGCCCAACAGTCAGGCCTTAGTCAGTCAGCCGGATTAGATACCCTAGTAGTC |
| (SEQ ID NO: 755) | CCTACGGGAGGCATCAGGCAGATCTCGCGATCGAACACTACTGAGCTGCATAGTCAGTCAGCCGGATTAGATACCCTAGTAGTC |
| (SEQ ID NO: 756) | CCTACGGGAGGCATCAGGCAGATCTCGCATGCCAACATGACGAAGTCTACCAGTCAGTCAGCCGGATTAGATACCCTAGTAGTC |
| (SEQ ID NO: 757) | CCTACGGGAGGCATCAGGCAGATCTCGGAGTACAGTCTAACCGTCTTTCTCAGTCAGTCAGCCGGATTAGATACCCTAGTAGTC |
| (SEQ ID NO: 758) | CCTACGGGAGGCATCAGGCAGATCTCGCCTACATGAGACAGTCTGTCTGCGAGTCAGTCAGCCGGATTAGATACCCTAGTAGTC |
| (SEQ ID NO: 759) | CCTACGGGAGGCATCAGGCAGATCTCGTCCGTGGTATAGCCGCACTCAAGTAGTCAGTCAGCCGGATTAGATACCCTAGTAGTC |
| (SEQ ID NO: 760) | CCTACGGGAGGCATCAGGCAGATCTCGTCTACGGCACGTTGTGGAAACTCCAGTCAGTCAGCCGGATTAGATACCCTAGTAGTC |
| (SEQ ID NO: 761) | CCTACGGGAGGCATCAGGCAGATCTCGATGCTGCAACACTTAGGCAGGTTCAGTCAGTCAGCCGGATTAGATACCCTAGTAGTC |
| (SEQ ID NO: 762) | CCTACGGGAGGCATCAGGCAGATCTCGTTCTCATGGAGGTAAGACTACTGGAGTCAGTCAGCCGGATTAGATACCCTAGTAGTC |
| (SEQ ID NO: 763) | CCTACGGGAGGCATCAGGCAGATCTCGCATAGTGATTGGCGCGAAGTTTCAAGTCAGTCAGCCGGATTAGATACCCTAGTAGTC |
| (SEQ ID NO: 764) | CCTACGGGAGGCATCAGGCAGATCTCGGCTATCAAGACACGATACACTGCCAGTCAGTCAGCCGGATTAGATACCCTAGTAGTC |
| (SEQ ID NO: 765) | CCTACGGGAGGCATCAGGCAGATCTCGCCGTGACAACTCTTGAAATCCCGGAGTCAGTCAGCCGGATTAGATACCCTAGTAGTC |
| (SEQ ID NO: 766) | CCTACGGGAGGCATCAGGCAGATCTCGCGTTCCTTGTTAGTTAGGGAGCGAAGTCAGTCAGCCGGATTAGATACCCTAGTAGTC |
| (SEQ ID NO: 767) | CCTACGGGAGGCATCAGGCAGATCTCGGGAATTATCGGTTTACTGTGGCCGAGTCAGTCAGCCGGATTAGATACCCTAGTAGTC |
| (SEQ ID NO: 768) | CCTACGGGAGGCATCAGGCAGATCTCGCATCAAGCATAGATATAAGGCCCAAGTCAGTCAGCCGGATTAGATACCCTAGTAGTC |

In another embodiment, spike-in control compositions are provided for use in a method that simultaneously 1) controls for cross-contamination and/or sample swapping and 2) allows for quantitation while controlling for different GC content samples (e.g., low, balanced, and high GC content). In this embodiment, nucleic acid constructs are used with barcode sequence fragments, and with GC content fragments where the barcode sequence fragments and the GC content fragments are positioned between universal sequence fragments (see FIG. 11). In one embodiment, the barcode sequence fragment is linked at its 3' end to the 5' end of the GC content fragment, and the barcode sequence fragment is linked at its 5' end to a universal sequence fragment while the GC content fragment is linked at its 3' end to a universal sequence fragment. In this embodiment, the GC content fragment can be used to control for polymerase, transposase, ligase, or repair enzyme GC content bias.

Figure 11:
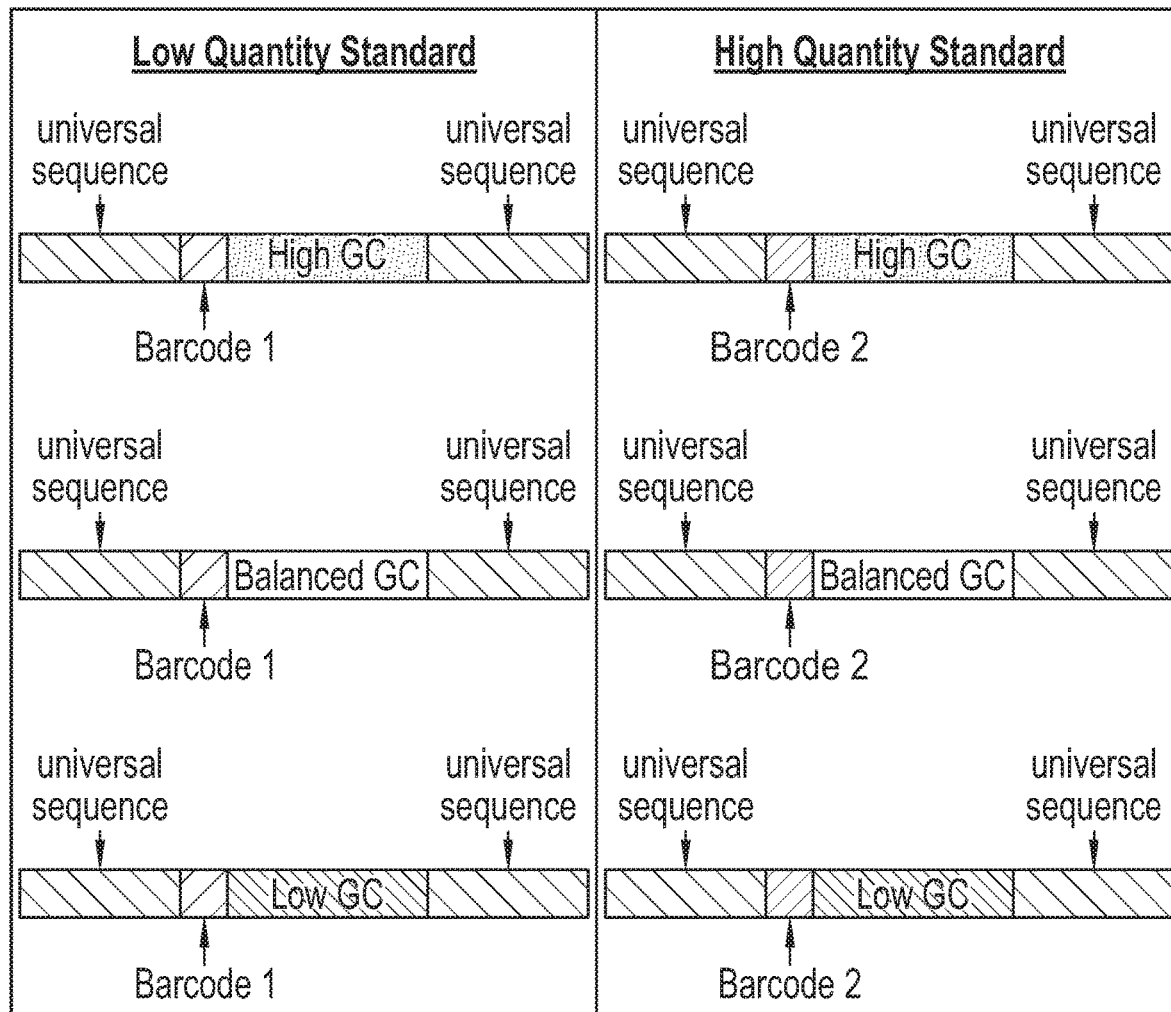
FIG. 11 shows a schematic of exemplary quantification spike-in control nucleic acid constructs where the nucleic acid constructs include universal sequence fragments for bioinformatic analysis, and where exemplary low concentration quantification nucleic acid constructs include a barcode sequence fragment (barcode 1), and exemplary high concentration quantification nucleic acid constructs include a barcode sequence fragment (barcode 2) that is different than the barcode sequence fragment in the low concentration quantification nucleic acid constructs. The schematic also exemplifies nucleic acid constructs with a low GC content fragment, a balanced GC content fragment, and a high GC content fragment.
Figure 12:
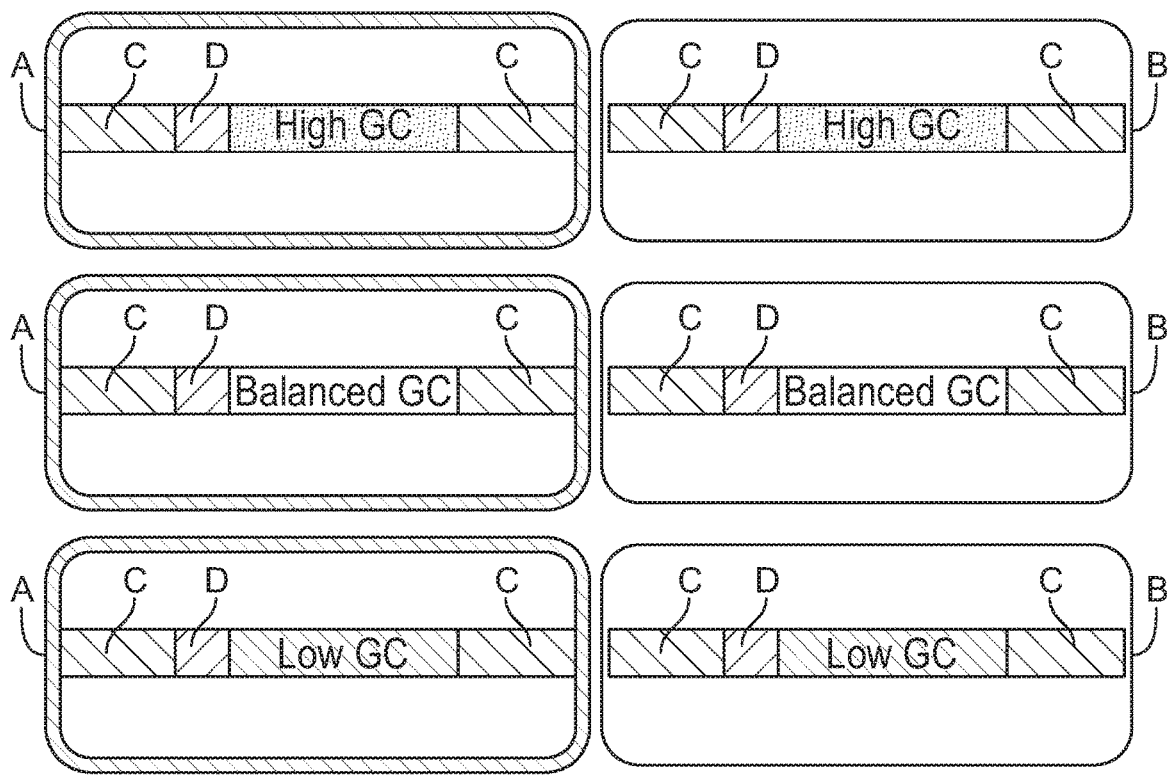
FIG. 12 shows a schematic of exemplary quantification spike-in control nucleic acid constructs encapsulated within simulated cell membranes highly resistant to lysis (A) and within non-resistant (easy to lyse) simulated cell membranes (B). The highly resistant cell membranes (e.g., liposomes) include, for example, lipid formulations with higher crystal transition temperatures, and higher amounts of LPS, PG, teichoic acids, PEG, cholesterol, and/or cationic lipids to condense the nucleic acid constructs. The non-resistant simulated cell membranes may, for example, omit the preceding ingredients or include them to a lesser degree.

By using the same type of nucleic acid construct, but with different barcode sequence fragments, different quantities of the nucleic acid construct can be spiked into samples (see the "Low Quantity Standard" and the "High Quantity Standard" with "Barcode 1" and "Barcode 2", respectively in FIG. 11), and a standard curve for quantitation can be produced. In this quantitation embodiment, the different GC content fragments (e.g., low, balanced, and high GC content) have the same barcode sequence fragment at each GC percentage (e.g., low, balanced, and high GC content), but for each separate concentrations of the nucleic acid constructs used to produce the standard curve (see the "Low Quantity Standard" and the "High Quantity Standard" in FIG. 11), the barcode sequence fragments are different so they can be differentiated post-sequencing. In this quantitation embodiment, the nucleic acid construct can be present at at least two, three, four or five different concentrations for use in generating a standard curve for the quantification of nucleic acids during sequencing.

Various embodiments of the GC content fragments are shown below in Tables 4 through 7.

TABLE 4

| Amplicon based controls | SEQ ID NO: | Forward Primer Binding Site Fragment | 5' Universal Sequence Fragment | Barcode Sequence Fragment | GC Content Fragment | 3' Universal Sequence Fragment | Reverse Primer Binding Site Fragment |
|---|---|---|---|---|---|---|---|
| 20%GC/ 80%ATcontrolseq1 | 2939 | CCTACGGGAGGCAT CAG | GCAGATCTC G | TCCCTTGT CTCCACGA GACTGATT | ATGATTACAGTTAACA GTATCTTAATGATTAC AGTTAACAGTATCTTA | AGTCAGTCA GCC | GGATTAGATACCCTAG TAGTC |
| 50%GC/ 50%ATcontrolseq1 | 2940 | CCTACGGGAGGCAT CAG | GCAGATCTC G | TCCCTTGT CTCCACGA GACTGATT | CTGACTGCAGTTAGCA GTACCTGAATGCTGAC AGTCAGCAGTACCTGA | AGTCAGTCA GCC | GGATTAGATACCCTAG TAGTC |
| 70%GC/ 30%ATcontrolseq1 | 2941 | CCTACGGGAGGCAT CAG | GCAGATCTC G | TCCCTTGT CTCCACGA GACTGATT | CGACGGCTCAGGCCTC AGCGTGGCCGACGGCT GAGGCCTCAGCGTGGC | AGTCAGTCA GCC | GGATTAGATACCCTAG TAGTC |

TABLE 4-continued

| Amplicon based controls | SEQ ID NO: | Forward Primer Binding Site Fragment | 5' Universal Sequence Fragment | Barcode Sequence Fragment | GC Content Fragment | 3' Universal Sequence Fragment | Reverse Primer Binding Site Fragment |
|---|---|---|---|---|---|---|---|
| 20%GC/ 80%ATcontrolseq2 | 2942 | CCTACGGGAGGCAT CAG | GCAGATCTC G | GCTGTACG GATTATCA CCAGGTGT | ATGATTACAGTTAACA GTATCTTAATGATTAC AGTTAACAGTATCTTA | AGTCAGTCA GCC | GGATTAGATACCCTAG TAGTC |
| 50%GC/ 50%ATcontrolseq2 | 2943 | CCTACGGGAGGCAT CAG | GCAGATCTC G | GCTGTACG GATTATCA CCAGGTGT | CTGACTGCAGTTAGCA GTACCTGAATGCTGAC AGTCAGCAGTACCTGA | AGTCAGTCA GCC | GGATTAGATACCCTAG TAGTC |
| 70%GC/ 30%ATcontrolseq2 | 2944 | CCTACGGGAGGCAT CAG | GCAGATCTC G | GCTGTACG GATTATCA CCAGGTGT | CGACGGCTCAGGCCTC AGCGTGGCCGACGGCT GAGGCCTCAGCGTGGC | AGTCAGTCA GCC | GGATTAGATACCCTAG TAGTC |

TABLE 5

| Full sequence |
|---|
| CCTACGGGAGGCATCAGGCAGATCTCGTCCCTTGTCTCCACGAGACTGA TTATGATTACAGTTAACAGTATCTTAATGATTACAGTTAACAGTATCTT AAGTCAGTCAGCCGGATTAGATACCCTAGTAGTC (SEQ ID NO: 2945) |
| CCTACGGGAGGCATCAGGCAGATCTCGTCCCTTGTCTCCACGAGACTGA TTCTGACTGCAGTTAGCAGTACCTGAATGCTGACAGTCAGCAGTACCTG AAGTCAGTCAGCCGGATTAGATACCCTAGTAGTC (SEQ ID NO: 2946) |
| CCTACGGGAGGCATCAGGCAGATCTCGTCCCTTGTCTCCACGAGACTGA TTCGACGGCTCAGGCCTCAGCGTGGCCGACGGCTGAGGCCTCAGCGTGG CAGTCAGTCAGCCGGATTAGATACCCTAGTAGTC (SEQ ID NO: 2947) |
| CCTACGGGAGGCATCAGGCAGATCTCGGCTGTACGGATTATCACCAGGT GTATGATTACAGTTAACAGTATCTTAATGATTACAGTTAACAGTATCTT AAGTCAGTCAGCCGGATTAGATACCCTAGTAGTC (SEQ ID NO: 2948) |
| CCTACGGGAGGCATCAGGCAGATCTCGGCTGTACGGATTATCACCAGGT GTCTGACTGCAGTTAGCAGTACCTGAATGCTGACAGTCAGCAGTACCTG AAGTCAGTCAGCCGGATTAGATACCCTAGTAGTC (SEQ ID NO: 2949) |
| CCTACGGGAGGCATCAGGCAGATCTCGGCTGTACGGATTATCACCAGGT GTCGACGGCTCAGGCCTCAGCGTGGCCGACGGCTGAGGCCTCAGCGTGG CAGTCAGTCAGCCGGATTAGATACCCTAGTAGTC (SEQ ID NO: 2950) |

TABLE 6

| WGS controls | SEQ ID NO: | 5' Universal Sequence Fragment | Barcode Sequence Fragment | GC Content Fragment | 3' Universal Sequence Fragment |
|---|---|---|---|---|---|
| 20%GC/ 80%ATcontrolseq1 | 2951 | GCAGATCTCGTACGCGA A | TCCCTTGTCTCCACGAG ACTGATT | ATGATTACAGTTAACA GTATCTTAATGATTAC AGTTAACAGTATCTTA | GTCATGACAGTCAGTCA GCC |
| 50%GC/ 50%ATcontrolseq1 | 2952 | GCAGATCTCGTACGCGA A | TCCCTTGTCTCCACGAG ACTGATT | CTGACTGCAGTTAGCA GTACCTGAATGCTGAC AGTCAGCAGTACCTGA | GTCATGACAGTCAGTCA GCC |
| 70%GC/ 30%ATcontrolseq1 | 2953 | GCAGATCTCGTACGCGA A | TCCCTTGTCTCCACGAG ACTGATT | CGACGGCTCAGGCCTC AGCGTGGCCGACGGCT GAGGCCTCAGCGTGGC | GTCATGACAGTCAGTCA GCC |
| 20%GC/ 80%ATcontrolseq2 | 2954 | GCAGATCTCGTACGCGA A | GCTGTACGGATTATCAC CAGGTGT | ATGATTACAGTTAACA GTATCTTAATGATTAC AGTTAACAGTATCTTA | GTCATGACAGTCAGTCA GCC |
| 50%GC/ 50%ATcontrolseq2 | 2955 | GCAGATCTCGTACGCGA A | GCTGTACGGATTATCAC CAGGTGT | CTGACTGCAGTTAGCA GTACCTGAATGCTGAC AGTCAGCAGTACCTGA | GTCATGACAGTCAGTCA GCC |
| 70%GC/ 30%ATcontrolseq2 | 2956 | GCAGATCTCGTACGCGA A | GCTGTACGGATTATCAC CAGGTGT | CGACGGCTCAGGCCTC AGCGTGGCCGACGGCT GAGGCCTCAGCGTGGC | GTCATGACAGTCAGTCA GCC |

TABLE 7

Full sequence

GCAGATCTCGTACGCGAATCCCTTGTCTCCACGAGACTGATTATGATTA
CAGTTAACAGTATCTTAATGATTACAGTTAACAGTATCTTAGTCATGAC
AGTCAGTCAGCC
(SEQ ID NO: 2957)

GCAGATCTCGTACGCGAATCCCTTGTCTCCACGAGACTGATTCTGACTG
CAGTTAGCAGTACCTGAATGCTGACAGTCAGCAGTACCTGAGTCATGAC
AGTCAGTCAGCC
(SEQ ID NO: 2958)

GCAGATCTCGTACGCGAATCCCTTGTCTCCACGAGACTGATTCGACGGC
TCAGGCCTCAGCGTGGCCGACGGCTGAGGCCTCAGCGTGGCGTCATGAC
AGTCAGTCAGCC
(SEQ ID NO: 2959)

GCAGATCTCGTACGCGAAGCTGTACGGATTATCACCAGGTGTATGATTA
CAGTTAACAGTATCTTAATGATTACAGTTAACAGTATCTTAGTCATGAC
AGTCAGTCAGCC
(SEQ ID NO: 2960)

GCAGATCTCGTACGCGAAGCTGTACGGATTATCACCAGGTGTCTGACTG
CAGTTAGCAGTACCTGAATGCTGACAGTCAGCAGTACCTGAGTCATGAC
AGTCAGTCAGCC
(SEQ ID NO: 2961)

GCAGATCTCGTACGCGAAGCTGTACGGATTATCACCAGGTGTCGACGGC
TCAGGCCTCAGCGTGGCCGACGGCTGAGGCCTCAGCGTGGCGTCATGAC
AGTCAGTCAGCC
(SEQ ID NO: 2962)

In this quantitation embodiment, the GC content fragment can be from about 100 base pairs in length to about 270 base pairs in length, from about 100 base pairs in length to about 260 base pairs in length, from about 100 base pairs in length to about 250 base pairs in length, from about 100 base pairs in length to about 240 base pairs in length, from about 100 base pairs in length to about 230 base pairs in length, from about 100 base pairs in length to about 220 base pairs in length, from about 100 base pairs in length to about 210 base pairs in length, from about 100 base pairs in length to about 200 base pairs in length, from about 100 base pairs in length to about 190 base pairs in length, from about 100 base pairs in length to about 180 base pairs in length, from about 100 base pairs in length to about 170 base pairs in length, from about 100 base pairs in length to about 160 base pairs in length, from about 100 base pairs in length to about 150 base pairs in length, from about 100 base pairs in length to about 140 base pairs in length, from about 100 base pairs in length to about 130 base pairs in length, from about 100 base pairs in length to about 120 base pairs in length, from about 50 base pairs in length to about 270 base pairs in length, from about 50 base pairs in length to about 260 base pairs in length, from about 50 base pairs in length to about 250 base pairs in length, from about 50 base pairs in length to about 240 base pairs in length, from about 50 base pairs in length to about 230 base pairs in length, from about 50 base pairs in length to about 220 base pairs in length, from about 50 base pairs in length to about 210 base pairs in length, from about 50 base pairs in length to about 200 base pairs in length, from about 50 base pairs in length to about 190 base pairs in length, from about 50 base pairs in length to about 180 base pairs in length, from about 50 base pairs in length to about 170 base pairs in length, from about 50 base pairs in length to about 160 base pairs in length, from about 50 base pairs in length to about 150 base pairs in length, from about 50 base pairs in length to about 140 base pairs in length, from about 50 base pairs in length to about 130 base pairs in length, from about 50 base pairs in length to about 120 base pairs in length, from about 60 base pairs in length to about 120 base pairs in length, from about 70 base pairs in length to about 120 base pairs in length, from about 80 base pairs in length to about 120 base pairs in length, from about 90 base pairs in length to about 120 base pairs in length, or from about 100 base pairs in length to about 120 base pairs in length.

In quantitation embodiments where GC content fragments are present, the GC content of the GC content fragments can vary. As exemplary embodiments, the GC content fragments can have GC contents of about 1 to about 40 percent, about 1 to about 35 percent, about 1 to about 30 percent, about 1 to about 25 percent, about 1 to about 20 percent, about 35 to about 65 percent, about 40 to about 65 percent, about 40 to about 60 percent, about 40 to about 55 percent, about 40 to about 50 percent, about 45 to about 65 percent, about 45 to about 60 percent, about 45 to about 55 percent, about 45 to about 50 percent, about 65 to about 100 percent, about 65 to about 95 percent, about 65 to about 90 percent, about 65 to about 85 percent, about 65 to about 80 percent, about 65 to about 75 percent, about 65 to about 70 percent, about 60 to about 100 percent, about 60 to about 95 percent, about 60 to about 90 percent, about 60 to about 85 percent, about 60 to about 80 percent, about 60 to about 75 percent, or about 60 to about 70 percent. In one aspect, the GC content fragments can have low (e.g., about 1 to about 40 percent), balanced (e.g., about 40 to about 60 percent or about 45 to about 60 percent), or high GC content (e.g., about 60 to about 100 percent or about 65 to about 100 percent). In this quantitation embodiment, the GC content fragments in different nucleic acid constructs can have, for example, at least one, two, three, or four different GC content percentages in the different nucleic acid constructs.

In this quantitation embodiment, the different GC content fragments (e.g., low, balanced, and high GC content) have the same barcode sequence fragment at each GC percentage (e.g., low, balanced, and high GC content), but at each separate concentration of the nucleic acid construct used to produce the standard curve (e.g., "Low Quantity Standard" and the "High Quantity Standard" in FIG. 11), the barcode sequence fragments are unique to each concentration used to produce the standard curve.

In quantitation embodiments for amplicon sequencing, the nucleic acid construct can further comprise at least a first and a second primer binding site fragment. In this aspect, the primers can be any primers of interest. In this embodiment, the first primer binding site fragment is linked at its 3' end to the 5' end of the first universal sequence fragment and the second primer binding site fragment is linked at its 5' end to the 3' end of the second universal sequence fragment. In embodiments for whole genome sequencing, the nucleic acid construct may lack primer binding site fragments. In embodiments where primer binding site fragments are included in the nucleic acid construct, the primer binding site fragments can range in length from about 15 base pairs to about 28 base pairs, from about 15 base pairs to about 26 base pairs, from about 15 base pairs to about 24 base pairs, from about base pairs to about 22 base pairs, from about 15 base pairs to about 20 base pairs, from about 16 base pairs to about 22 base pairs, from about 16 base pairs to about 20 base pairs, from about 17 base pairs to about 20 base pairs, or can be about 18 base pairs.

In an illustrative embodiment of the quantitation embodiment, the nucleic acid construct is a deoxyribonucleic acid construct. In another aspect, the nucleic acid construct is a ribonucleic acid. In another embodiment, the nucleic acid construct is incorporated into a plasmid. In yet another embodiment, the nucleic acid construct is incorporated into the genome of an organism.

In all of the various quantitation embodiments described above, the entire nucleic acid construct, not including plasmid sequence if a plasmid is present, can range in length from about 80 base pairs to about 300 base pairs, from about 80 base pairs to about 290 base pairs, from about 80 base pairs to about 280 base pairs, from about 80 base pairs to about 270 base pairs, from about 80 base pairs to about 260 base pairs, from about 80 base pairs to about 250 base pairs, from about 80 base pairs to about 240 base pairs, from about 80 base pairs to about 230 base pairs, from about 80 base pairs to about 220 base pairs, from about 80 base pairs to about 210 base pairs, from about 80 base pairs to about 200 base pairs, from about 80 base pairs to about 190 base pairs, from about 80 base pairs to about 180 base pairs, from about 80 base pairs to about 170 base pairs, or from about 80 base pairs to about 160 base pairs.

In another embodiment, any of the nucleic acids constructs, incorporated into a plasmid or not incorporated or encapsulated or not encapsulated, can be in the form of a kit. In this illustrative aspect, the kit can further comprise a reagent for nucleic acid extraction, a reagent for nucleic acid purification, a reagent for library preparation, a reagent for amplification, a probe (for example for use in exome/targeted hybridization sequencing as described below), a reagent for sequencing, a reagent for chemical analyses, such as mass spectrometry, and/or instructions for use of the kit. In this illustrative embodiment, the kit can comprise more than one of the control compositions for sequencing or chemical analyses wherein each control composition comprises a different nucleic acid construct wherein the different nucleic acid constructs comprise different barcode sequence fragments (e.g., the 384 barcode sequence fragments contained in SEQ ID NOS:1 to 384 or SEQ ID NOS:384 to 768, or, for example, a subset of 96 of these sequences for use in multiplex sequencing applications).

In yet another illustrative aspect, a kit for quantitation of nucleic acids during sequencing can comprise more than one of any of the control compositions described herein wherein each control composition comprises a different nucleic acid construct wherein the different nucleic acid constructs comprise different barcode sequence fragments. In this quantitation embodiment, the nucleic acid constructs comprising different barcode sequence fragments can be spiked into the sample at different concentrations (see the "Low Quantity Standard" and the "High Quantity Standard" with "Barcode 1" and "Barcode 2", respectively in FIG. 11), and a standard curve for quantitation can be produced. In this quantitation embodiment, each separate concentration of the nucleic acid construct used to produce the standard curve has different barcode sequence fragments so that the different concentrations can be differentiated post-sequencing.

Figure 13A:
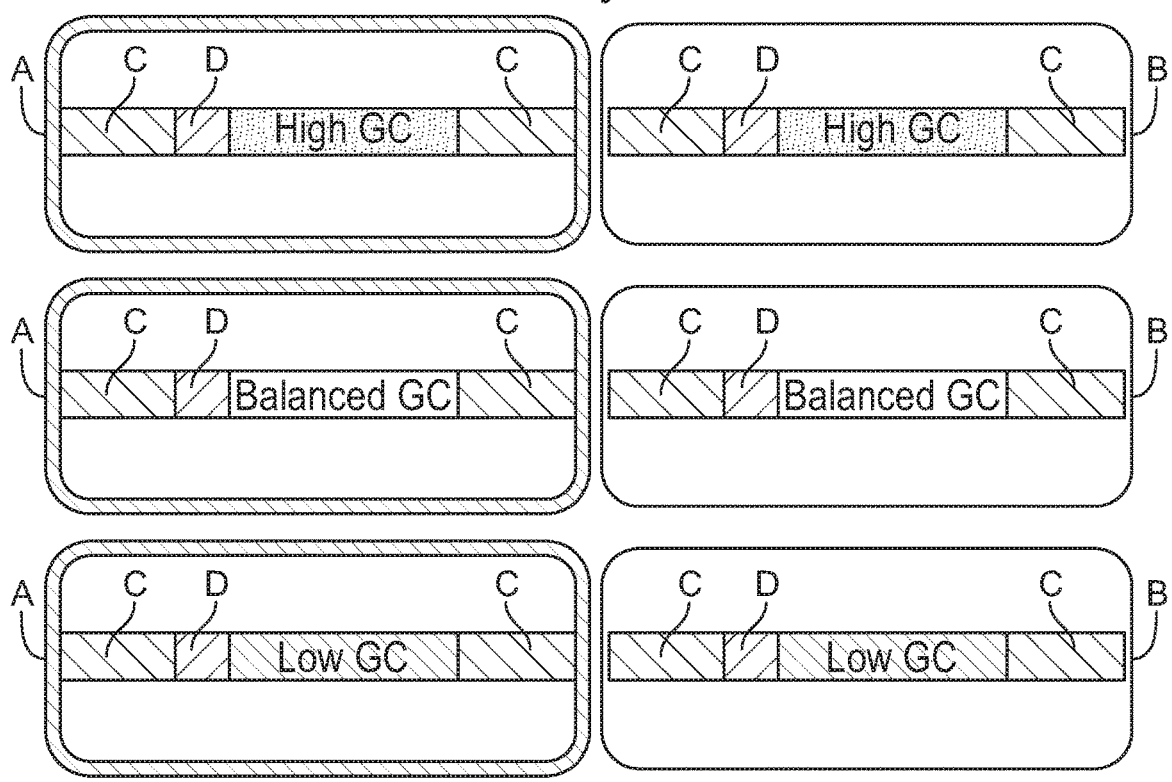
FIGS. 13A and B show a schematic of exemplary low (FIG. 13A) and high (FIG. 13B) concentration quantification nucleic acid constructs encapsulated in different simulated cell membranes to control for differential lysis during sample preparation and processing. Highly resistant (FIG. 13A) and non-resistant (FIG. 13B) simulated cell membranes contain nucleic acid constructs which include universal sequence fragments for bioinformatic analysis (C), a first barcode sequence fragment (barcode 1; D) for the lower concentration constructs, and a second barcode sequence fragment (barcode 2; D) for the higher concentration constructs. The schematic also exemplifies nucleic acid constructs with a low GC content fragment, a balanced GC content fragment, and a high GC content fragment. To apply the quantification standards to amplicon sequencing, a forward primer binding site fragment can be added to the nucleic acid construct on the 5' end of the 5' universal sequence fragment and a reverse primer binding site fragment can be added to the 3' end of the 3' universal sequence fragment. The amplicon sequencing constructs could be either linear or within plasmids.
Figure 13B:
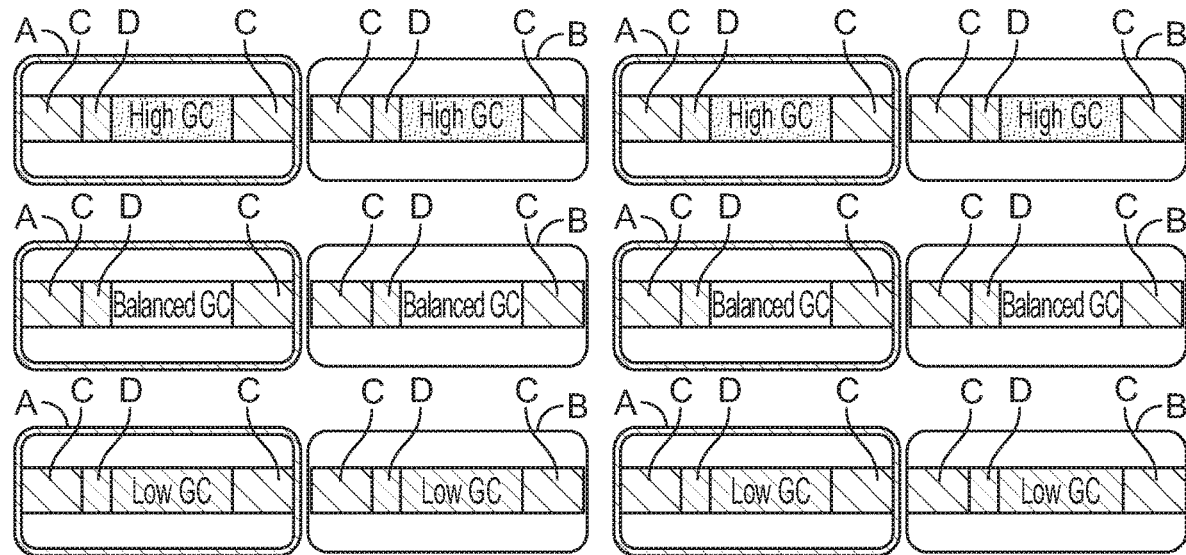
Figure 13B:
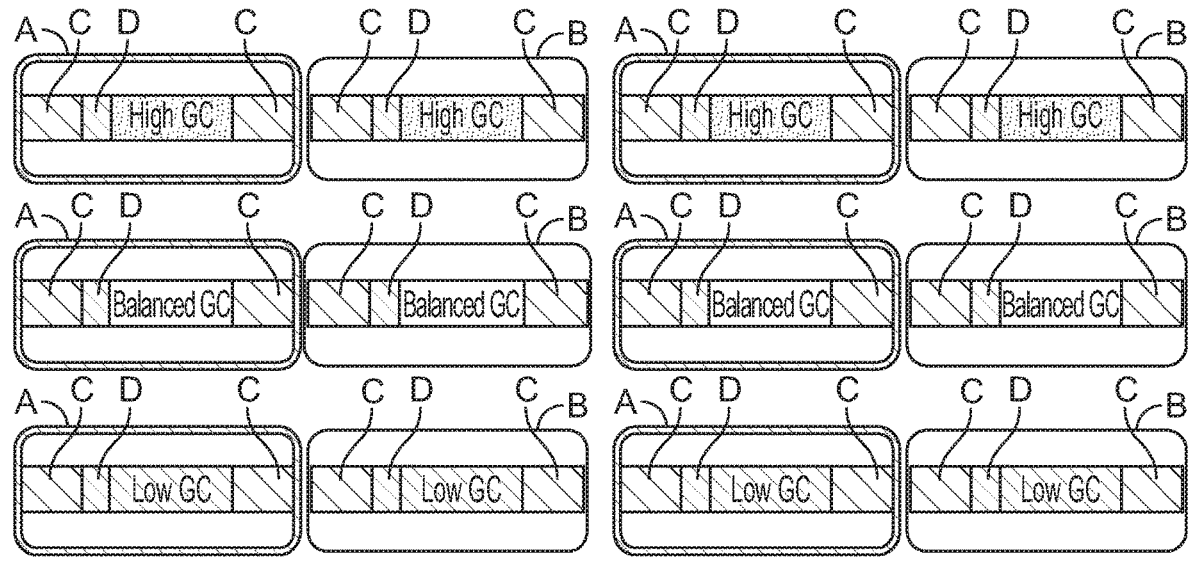

In yet another illustrative aspect, the kits described herein can comprise more than one of any of the control compositions described herein wherein the nucleic acid construct in each control composition is encapsulated in a different type of liposome. In this embodiment, each control composition wherein the nucleic acid construct is encapsulated in a different type of liposome may have a different barcode sequence fragment to differentiate the various types of liposomes post-sequencing (see FIG. 13).

In one embodiment, the probes for use in exome/targeted hybridization sequencing, primers for use in amplicon sequencing, whole genome sequencing, or exome/targeted hybridization sequencing, and the nucleic acid constructs, including nucleic acid constructs incorporated into a plasmid, described herein can be made by methods well-known in the art, including syntheses and recombinant methods. Such techniques are described in Sambrook et al., "Molecular Cloning: A Laboratory Manual", 3rd Edition, Cold Spring Harbor Laboratory Press, (2001), incorporated herein by reference. Plasmids, primers, probes, and the nucleic acid constructs described herein can also be made commercially (e.g., Blue Heron, Bothell, Wash. 98021). Techniques for purifying or isolating the probes, primers, or nucleic acid constructs, including nucleic acid constructs incorporated into a plasmid, described herein are well-known in the art. Such techniques are described in Sambrook et al., "Molecular Cloning: A Laboratory Manual", 3rd Edition, Cold Spring Harbor Laboratory Press, (2001), incorporated herein by reference. The nucleic acid constructs, including nucleic acid constructs incorporated into a plasmid, described herein can be analyzed by techniques known in the art, such as sequencing, to determine if the sequence is correct.

In one illustrative aspect, the nucleic acid construct, incorporated into a plasmid or not incorporated into a plasmid, can be encapsulated. In one exemplary embodiment, the nucleic acid construct, incorporated into a plasmid or not incorporated into a plasmid, can be encapsulated in a liposome, and the liposome can comprise a lipid selected from the group consisting of cholesterol, a cholesterol ester salt, a lipopolysaccharide, a sphingolipid, a peptidoglycan, a phospholipid, any other suitable lipid, and combinations thereof.

In this embodiment, liposomes can be closed, spherical vesicles comprising amphiphilic lipids in proportions such that they arrange themselves into multiple concentric bilayers when hydrated in aqueous solutions. In another aspect, the liposomes can be converted into single bilayer liposomes which are useful carriers of both hydrophilic molecules, which can reside entrapped in the aqueous interior of the liposome, and of hydrophobic molecules, which can reside entrapped in the lipid bilayer. An exemplary hydrophilic chain constituent is polyethylene glycol.

In various embodiments, the lipids can include those having two hydrocarbon chains, typically acyl chains, and a polar head group, such as phospholipids and glycolipids. In this aspect, phospholipids may include any one type of phospholipid or a combination of phospholipids capable of forming liposomes, including, but not limited to, phosphatidylcholines, phosphatidylethanolamine, phosphatidic acid, phosphatidylinositol, and sphingomyelin, where the two hydrocarbon chains are typically between about 14 to 22 carbons in length, and have varying degrees of unsaturation. The glycolipids include, but are not limited to, cerebrosides and gangliosides. Exemplary phosphatidylcholines, include those obtained from natural sources or those that are partially or wholly synthetic, or are of variable chain length and unsaturation.

In various embodiments, the nucleic acid construct can be encapsulated, incorporated into a plasmid or not incorporated into a plasmid, into a simulated cell membrane that mimics the cell membrane of the microorganism or a eukaryotic cell, or another cell of interest. In one illustrative embodiment, lipids with varying crystal transition temperatures, including cholesterol and lipopolysaccharide, can be incorporated during encapsulation to better mimic the mechanical and material characteristics of a microorganism cell wall (e.g., a bacterial cell wall). In this embodiment, variation in liposome production parameters such as the lipid:DNA ratio, the solvent:non-solvent ratio, and the lipid charge can be used to better tune the liposome composition and size to mimic the cell membrane of the microorganism or a eukaryotic cell, or another cell of interest.

For example, membrane rigidity may be increased with increasing amounts of cholesterol. In one embodiment, this allows the production of a range of liposomes that include easy to lyse (i.e., non-resistant liposomes) through difficult to lyse liposomes (i.e., resistant liposomes). In another embodiment, LPS may be used to mimic Gram-negative bacterial membranes. The hydrated saccharide chains can act as a barrier to hydrophobic species while the phospholipid layer can act as a barrier to hydrophilic species. A periplasm layer of water and peptidoglycan (PG) separates the LPS outer membrane from an inner membrane composed of a more conventional phospholipid lipid bilayer. Polyethylene Glycol (PEG) is a hydrophilic, biologically inert, synthetic material that may confer similar membrane robustness. The PEG can assemble into a brush-like layer on the outer membrane of the liposomes, and act as a hydrated barrier while also increasing the apparent size. Although PEG has been extensively used in liposomes for drug delivery, it may not have been demonstrated as an LPS mimic in an artificial cell. PG, teichoic acids, or similar materials can be added to mimic a Gram-positive cell wall, as the thick PG layers increase lysis resistance. In one aspect, after synthesis, liposome size can be adjusted by extruding the liposomes through a filter membrane with well-defined pore sizes. In this embodiment, the final liposome will comprise small, unilamellar vesicles with a size that is determined by the pore size in the membrane used for extrusion. With no extrusion step, the liposomes may be larger, multi-lamellar liposomes.

In one illustrative aspect, direct encapsulation of the nucleic acid construct without a plasmid or genome backbone (shown schematically in FIG. 7A), may be beneficial for whole genome sequencing applications, because there will not be extraneous DNA that could affect whole genome sequencing using non-targeted approaches.

Figure 6A:
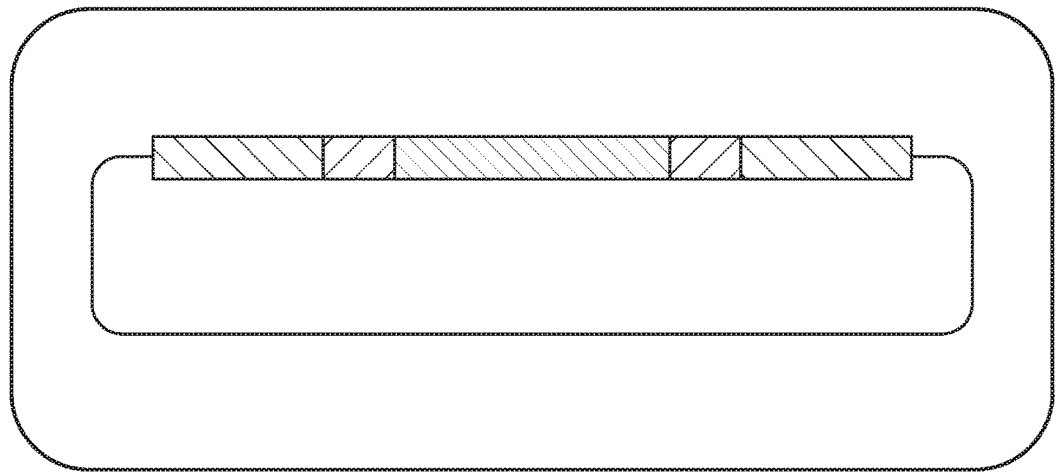
FIG. 6A shows schematically the exemplary nucleic acid construct of FIG. 5 as described herein cloned into a plasmid for amplicon sequencing applications.
Figure 6B:
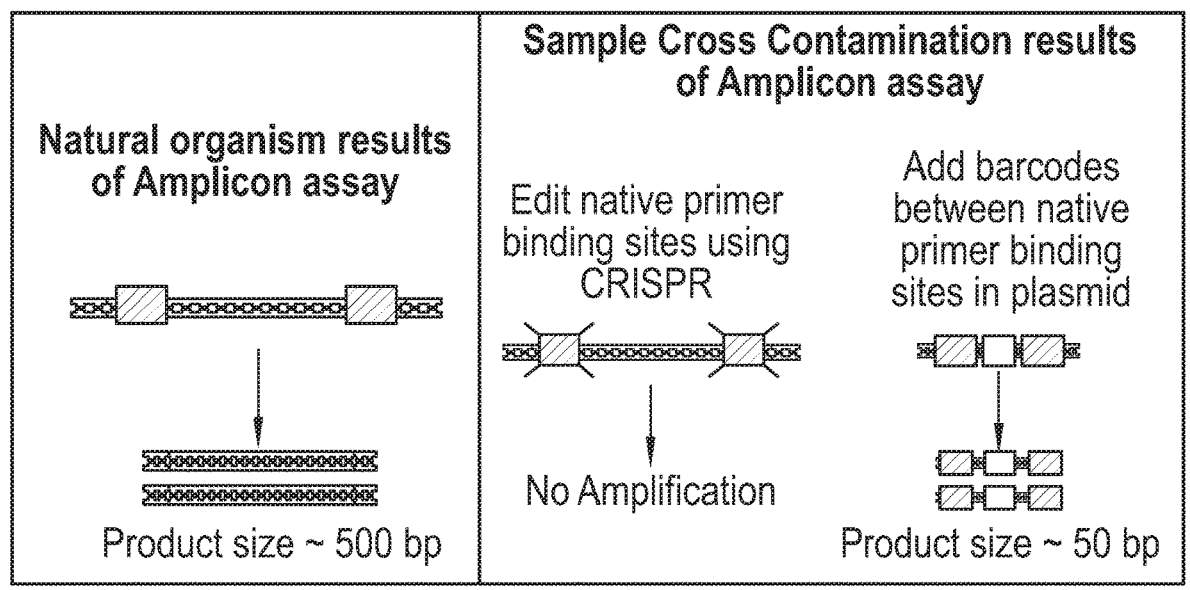
FIG. 6B shows schematically the exemplary nucleic acid construct of FIG. 5 as described herein inserted into the genome of a microorganism. In one aspect, the microorganism could be modified utilizing gene editing (e.g., CRISPR) so that the natural primer binding sites are removed before inserting the nucleic acid construct described herein into the genome of the microorganism.

In all of the encapsulation embodiments described above, encapsulation of the control composition for sequencing or chemical analyses, including the nucleic acid construct, or by incorporation into the genome of a cell (e.g., a bacterial or eukaryotic cell) allows for the control composition for sequencing or chemical analyses to be used in every step of sequencing analysis or chemical analyses of an unknown test sample: from extraction to purification to library preparation, sequencing, or chemical analyses, and data analysis because degradation of the control sample can be avoided so that sample cross-contamination and sample swapping can be effectively monitored throughout the protocol. In another aspect for the quantitation embodiments described herein, the nucleic acid constructs can be encapsulated in a simulated cell membrane to control for differential lysis during sample preparation. In another illustrative aspect, encapsulation of the nucleic acid constructs described herein can enable simultaneous quantification that is controlled for extraction efficiency, cross contamination control, and extraction quality control In embodiments where the nucleic acid construct is not artificially encapsulated in, for example, a liposome, the nucleic acid construct can be incorporated into the genome of a microorganism for use as a control composition for sequencing. This embodiment is shown schematically in FIGS. 6A and B as is applicable to amplicon sequencing. If the primer binding sites are present in the microorganism to be utilized, the microorganism could be modified utilizing gene editing, for example, so that the natural primer binding sites are removed (see FIG. 6B). In another embodiment, the barcode sequence fragment could be inserted into the genome of a microorganism between natural primer binding sites. In one aspect, the microorganism could be modified utilizing gene editing so that the sequence between the natural primer binding sites is replaced with the barcode. In one aspect, the CRISPR/Cas9 system for genome editing could be used as well as other genome editing systems, such as ZFNs, custom designed homing endonucleases, and TALENS systems.

The CRISPR/Cas9 system for genome editing has benefits over other genome editing systems. In this embodiment, the Cas9 endonuclease is capable of introducing a double strand break into a DNA target sequence (e.g., the natural primer binding sites described above). In this aspect, the Cas9 endonuclease is guided by the guide polynucleotide (e.g., guide RNA) to recognize and optionally introduce a double strand break at a specific target site into the genome of a cell, such as a microorganism, a eukaryotic cell, or another cell of interest for use in the methods described herein. The Cas9 endonuclease can unwind the DNA duplex in close proximity to the genomic target site and cleaves both DNA strands upon recognition of a target sequence by a guide polynucleotide (e.g., guide RNA), but only if the correct protospacer-adjacent motif (PAM) is approximately oriented at the 3' end of the target. In this embodiment, the donor polynucleotide construct (e.g., the nucleic acid construct described herein) can then be incorporated into the genomic target site. Methods for using the CRISPR/Cas9 system for genome editing are well-known in the art.

In one illustrative aspect, for sequencing or chemical analyses, the nucleic acids in the sample (e.g., microorganisms such as bacteria or viruses) and the nucleic acids in the control composition for sequencing or chemical analyses (e.g., the nucleic acid construct incorporated or not incorporated into a plasmid or into the genome of a microorganism), are extracted and purified for analysis. In various embodiments, the preparation of the nucleic acids (e.g., DNA or RNA) can involve rupturing the cells that contain the nucleic acids (e.g., cells of a microorganism or the nucleic acid construct in a simulated cell membrane) and isolating and purifying the nucleic acids (e.g., DNA or RNA) from the lysate. Techniques for rupturing cells and for isolation and purification of nucleic acids (e.g., DNA or RNA) are well-known in the art. In one embodiment, for example, nucleic acids may be isolated and purified by rupturing cells using a detergent or a solvent, such as phenol-chloroform. In another aspect, nucleic acids (e.g., DNA or RNA) may be separated from the lysate by physical methods including, but not limited to, centrifugation, pressure techniques, or by using a substance with an affinity for nucleic acids (e.g., DNA or RNA), such as, for example, beads that bind nucleic acids. In one embodiment, after sufficient washing, the isolated, purified nucleic acids may be suspended in either water or a buffer. In another aspect, the nucleic acids (e.g., DNA or RNA) are "isolated" or "purified" before sequencing. In one embodiment, "isolated" means that the nucleic acids are removed from their normal environment. In another aspect, "purified" in the context of the nucleic acids that are sequenced means the nucleic acids are substantially free of other cellular material, or culture medium, or other chemicals used in the extraction process. In other embodiments, commercial kits are available, such as Qiagen™ (e.g., Qiagen DNeasy PowerSoil Kit™), Nuclisensm™, and Wizard™ (Promega), and Promegam™ for extraction and purification of nucleic acids. Methods for preparing nucleic acids for sequencing or chemical analyses and library preparation are also described in Green and Sambrook, "Molecular Cloning: A Laboratory Manual", 4th Edition, Cold Spring Harbor Laboratory Press, (2012), incorporated herein by reference.

In one illustrative aspect, after preparation for sequencing of the nucleic acids in the sample (e.g., in microorganisms such as bacteria or viruses) and the nucleic acid constructs in the control compositions for sequencing or chemical analyses (e.g., nucleic acid construct incorporated or not incorporated into a plasmid or the genome of a microorganism), a library can be prepared, and the nucleic acids can be sequenced using any suitable sequencing method. In one embodiment, Next Generation Sequencing (e.g., using Illumina, ThermoFisher, or PacBio or Oxford Nanopore Technologies sequencing platforms), sequencing by synthesis, pyrosequencing, nanopore sequencing, or modifications or combinations thereof can be used.

In one embodiment, the sequencing can be amplicon sequencing. In another embodiment, the sequencing can be whole genome sequencing. Whole genome sequencing includes, for example, metagenomics, and is utilized heavily in environmental microbial community research, microbiome research, and cancer or human diagnostics. In another embodiment, the sequencing can be exome/targeted hybridization sequencing.

Figure 8A:
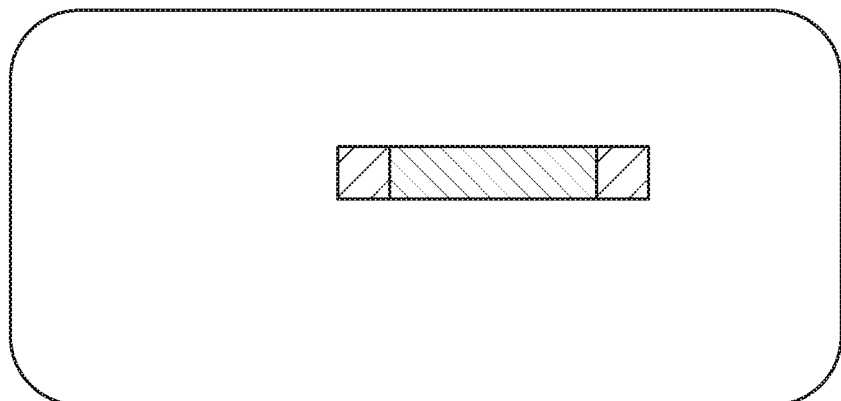
FIG. 8A shows schematically an exemplary construct for exome/targeted hybridization sequencing, encapsulated (e.g., in a liposome). In this example, the nucleic acid construct comprises universal sequence fragments flanking a barcode sequence fragment.
Figure 8B:
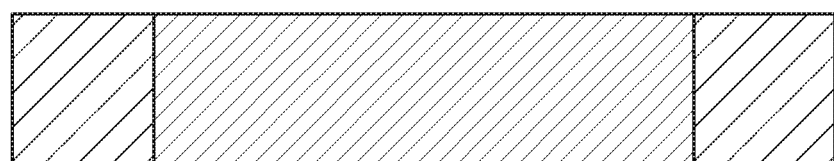
FIG. 8B shows schematically an exemplary probe for exome/targeted hybridization sequencing wherein the probe can be, for example, complementary to the universal sequence fragments (end fragments) with inosines in place of the barcode sequence fragment (middle fragment). Hybridization may occur between the nucleic acid construct of FIG. 8A and the probe of FIG. 8B, and the probe may be a streptavidin sequence probe which binds the sequence of interest, and then is bound to immobilized biotin to enrich the targeted sequences and remove sequences that are not of interest from the library. The targets can then be amplified prior to sequencing.

An exemplary nucleic acid construct and probe for exome/targeted hydridization sequencing is shown schematically in FIGS. 8A and B. In this embodiment, the nucleic acid construct comprises universal sequence fragments and a barcode sequence fragment between the universal sequence fragments (FIG. 8A). In this embodiment, if quantitation is used, GC content fragments can also be included. In this embodiment, the control composition for sequencing can be processed alongside the sample for whole genome sequencing: the control composition for sequencing is spiked into the sample, the DNA is extracted and purified, and a library preparation is conducted. Subsequently a hybridization can occur using streptavidin sequence probes, for example, to bind the nucleic acid construct and other sequences of interest. In this illustrative embodiment, other sequences are removed from the library, and the targets are amplified prior to sequencing. In this embodiment, the probe, at its ends, can be complementary to the universal sequence fragments in the nucleic acid construct, with inosines in the probe in place of the barcode sequence fragment to allow for hybridization of the probe to the universal sequence fragments in the nucleic acid construct. However, no hybridization occurs across the unique barcode sequence fragment to allow for sequencing after the amplification.

In one aspect, libraries can be pooled and concentrated before sequencing. Methods for library preparation and for sequencing are described in Green and Sambrook, "Molecular Cloning: A Laboratory Manual", 4th Edition, Cold Spring Harbor Laboratory Press, (2012), incorporated herein by reference. In one illustrative aspect, after sequencing, the number of reads (i.e., read counts) obtained by sequencing the nucleic acids in the sample or the nucleic acids in the control compositions for sequencing (e.g., nucleic acid construct incorporated or not incorporated into a plasmid or the genome of a microorganism) can be determined.

In various illustrative embodiments, using the control compositions for sequencing or chemical analyses described herein, patient samples or environmental samples (e.g., containing animal, plant, bacteria, viruses, fungi, or archaea) can be analyzed by sequencing or chemical analyses. In accordance with the invention, the term "patient" means a human or an animal, such as a domestic animal (e.g., a dog or a cat). Accordingly, the methods and control compositions for sequencing or chemical analyses described herein can be used, for example, for human clinical medicine (e.g., infectious disease diagnosis, cancer genomics, mendelian genetic testing, and paternity testing), veterinary applications, forensics, environmental or ecological use, and consumer sequencing services such as ancestry DNA, American Gut, or other amplicon sequencing-based technologies that sequence amplicons to determine ancestry or the consumer's microbiome composition.

In various aspects, the patient can be a human, or in the case of veterinary applications, can be a laboratory, agricultural, domestic or wild animal. In one embodiment, the patient can include, but is not limited to, a human, a laboratory animal such as a rodent (e.g., mice, rats, hamsters, etc.), a rabbit, a monkey, a chimpanzee, a domestic animal such as a dog, a cat, and a rabbit, and an agricultural animal such as a cow, a horse, a pig, a sheep, a goat, a chicken, and a wild animal in captivity such as a bear, a panda, a lion, a tiger, a leopard, an elephant, a zebra, a giraffe, a gorilla, a dolphin, and a whale.

In various illustrative embodiments, the samples that can be tested using the control compositions for sequencing or chemical analyses and the methods described herein comprise patient body fluids including, but not limited to, urine, nasal secretions, nasal washes, inner ear fluids, bronchial lavages, bronchial washes, alveolar lavages, spinal fluid, bone marrow aspirates, sputum, pleural fluids, synovial fluids, pericardial fluids, peritoneal fluids, saliva, tears, gastric secretions, stool, reproductive tract secretions, such as seminal fluid, lymph fluid, and whole blood, serum, or plasma, or any other suitable patient sample. In another embodiment, nucleic acids extracted from microorganisms (e.g., bacteria or viruses) isolated or purified from patient samples or environmental samples can be tested using the control compositions for sequencing or chemical analyses and methods described herein. In various embodiments, patient tissue samples that can be tested by using the control compositions for sequencing or chemical analyses and the methods described herein can include tissue biopsies of hospital patients or out-patients and autopsy specimens. As used herein, the term "tissue" includes, but is not limited to, biopsies (including tumor biopsies), autopsy specimens, cell extracts, hair, tissue sections, aspirates, tissue swabs, and fine needle aspirates.

In various illustrative embodiments, environmental samples that can be tested by using the control compositions for sequencing or chemical analyses and the methods described herein can be selected from the group consisting of a soil sample, a water sample, a food sample, an air sample, a plant sample, an industrial waste sample, an agricultural sample, a surface wipe sample, a dust sample, a hair sample, and an animal sample, or any other suitable environmental sample.

In another illustrative embodiment, any of the unencapsulated or encapsulated nucleic acid constructs, incorporated into a plasmid or not incorporated into a plasmid, as described herein may be spiked into a sample that will undergo analysis by an analytical chemistry method, such as mass spectrometry, thermal analysis, electrochemical analysis, chromatographic analysis, and the like. In this embodiment, the analytical chemistry analysis may be quantitative and/or qualitative and the small molecules analyzed may be inorganic or organic compounds. In this aspect, the analysis may be selected from the group consisting of forensic analysis, environmental analysis, industrial analysis (e.g., quality control), or medical analysis. In this illustrative aspect, the nucleic acid construct samples can be extracted and treated in a similar fashion as the analytical chemistry samples, and archived samples, after the analytical chemistry analysis protocol is performed, can be saved for sequencing analysis of the cross-contamination or sample swapping controls. In this embodiment, forensic analysis, for example, may be stomach content analysis, checking blood alcohol content, monitoring substance abuse, toxin analysis, poison analysis, and the like. In this embodiment, the archived samples can be subjected to DNA sequencing to confirm or deny cross-contamination or sample swapping (e.g., at the time of sample collection).

In various illustrative embodiments, the microorganisms present in the patient sample or the environmental sample to be tested can be bacteria or viruses. In this aspect, the bacteria can be selected from Gram-negative and Gram-positive cocci and bacilli, and can comprise antibiotic-resistant bacteria. In another illustrative aspect, the bacteria can be selected from the group consisting of *Pseudomonas* species, *Staphylococcus* species, *Streptococcus* species, *Escherichia* species, *Haemophilus* species, *Neisseria* species, *Chlamydia* species, *Helicobacter* species, *Campylobacter* species, *Salmonella* species, *Shigella* species, *Clostridium* species, *Treponema* species, *Ureaplasma* species, *Listeria* species, *Legionella* species, *Mycoplasma* species, and *Mycobacterium* species, or the group consisting of *S. aureus, P. aeruginosa*, and *E. coli*. In another aspect, the viruses can be selected from DNA and RNA viruses, or can be selected from the group consisting of papilloma viruses, parvoviruses, adenoviruses, herpesviruses, vaccinia viruses, arenaviruses, coronaviruses, rhinoviruses, respiratory syncytial viruses, influenza viruses, picornaviruses, paramyxoviruses, reoviruses, retroviruses, and rhabdoviruses. In another illustrative embodiment, mixtures of any of these microorganisms can be present in the patient sample or the environmental sample. In yet another embodiment, the sample to be tested comprises eukaryotic cells.

In one illustrative aspect, a method is provided using any of the non-quantitation control compositions described herein. The method is for monitoring cross-contamination or sample swapping over all steps of a DNA sequencing protocol including collection of a sample comprising DNA, DNA extraction from the sample, purification of the extracted DNA, library preparation, and sequencing. The method comprises a) spiking the sample with a control composition comprising a nucleic acid construct wherein the nucleic acid construct comprises at least one barcode sequence fragment linked to at least one universal sequence fragment and wherein the nucleic acid construct is a deoxyribonucleic acid construct, b) extracting total DNA wherein total DNA comprises the DNA from the sample and DNA from the nucleic acid construct, c) purifying total DNA, d) preparing a library from total DNA, e) sequencing the extracted, purified total DNA, and f) detecting the nucleic acid construct in total DNA.

In another embodiment, a method is provided using any of the quantitation control compositions described herein that contain GC content fragments, where the method is for monitoring sample cross-contamination and/or sample swapping and for quantification of nucleic acids during sequencing. The method comprises a) extracting DNA from a sample, b) purifying the DNA, c) spiking the sample, after DNA extraction and purification and before library preparation, with a control composition comprising a nucleic acid construct wherein the nucleic acid construct comprises at least one barcode sequence fragment, at least one universal sequence fragment, and at least one GC content fragment, and wherein the nucleic acid construct is a deoxyribonucleic acid construct, wherein total DNA is obtained after spiking the sample, and wherein total DNA comprises the DNA from the sample and the DNA from the nucleic acid construct, d) preparing a library from total DNA, e) sequencing total DNA, and f) detecting and quantifying the nucleic acid construct in total DNA.

In another embodiment, a method is provided using any of the quantitation control compositions described herein that contain GC content fragments. The method is for monitoring sample cross-contamination and/or sample swapping and for quantification of nucleic acids during sequencing. The method comprises a) spiking a sample with a control composition comprising a nucleic acid construct wherein the nucleic acid construct comprises at least one barcode sequence fragment, at least one universal sequence fragment, and at least one GC content fragment and wherein the nucleic acid construct is a deoxyribonucleic acid construct, b) extracting total DNA from the sample wherein total DNA comprises the DNA from the sample and the DNA from the nucleic acid construct, c) purifying total DNA, d) preparing a library from total DNA, e) sequencing total DNA, and f) detecting and quantifying the nucleic acid construct in total DNA.

In another illustrative aspect, a method is provided using any of the non-quantitation control compositions described herein. The method is for monitoring cross-contamination or sample swapping over steps of a DNA sequencing protocol including collection of a sample comprising DNA, DNA extraction from the sample, purification of the extracted DNA, library preparation, and sequencing. The method comprises a) spiking the sample, after DNA extraction and purification and before library preparation, with a control composition comprising a nucleic acid construct wherein the nucleic acid construct comprises at least one barcode sequence fragment, at least one universal sequence fragment, and wherein the nucleic acid construct is a deoxyribonucleic acid construct, wherein total DNA comprises the DNA from the sample and the DNA from the nucleic acid construct, b) extracting total DNA, c) purifying total DNA, d) preparing a library from total DNA, e) sequencing the extracted, purified total DNA, and f) detecting the nucleic acid construct in total DNA.

In another embodiment, a method for monitoring cross-contamination or sample swapping during an analytical chemistry protocol is provided. The method comprises a) spiking an analytical chemistry protocol sample with a control composition comprising a nucleic acid construct wherein the nucleic acid construct comprises at least one barcode sequence fragment linked to at least one universal sequence fragment and wherein the nucleic acid construct is a deoxyribonucleic acid construct; b) performing the analytical chemistry protocol; c) archiving a sample from the analytical chemistry protocol; d) extracting total DNA from the archived sample wherein total DNA comprises the DNA from the nucleic acid construct and DNA from the analytical chemistry protocol sample, if any; e) purifying total DNA; f) preparing a library from total DNA; g) sequencing the extracted, purified total DNA; and h) detecting the nucleic acid construct in total DNA.

Figure 9:
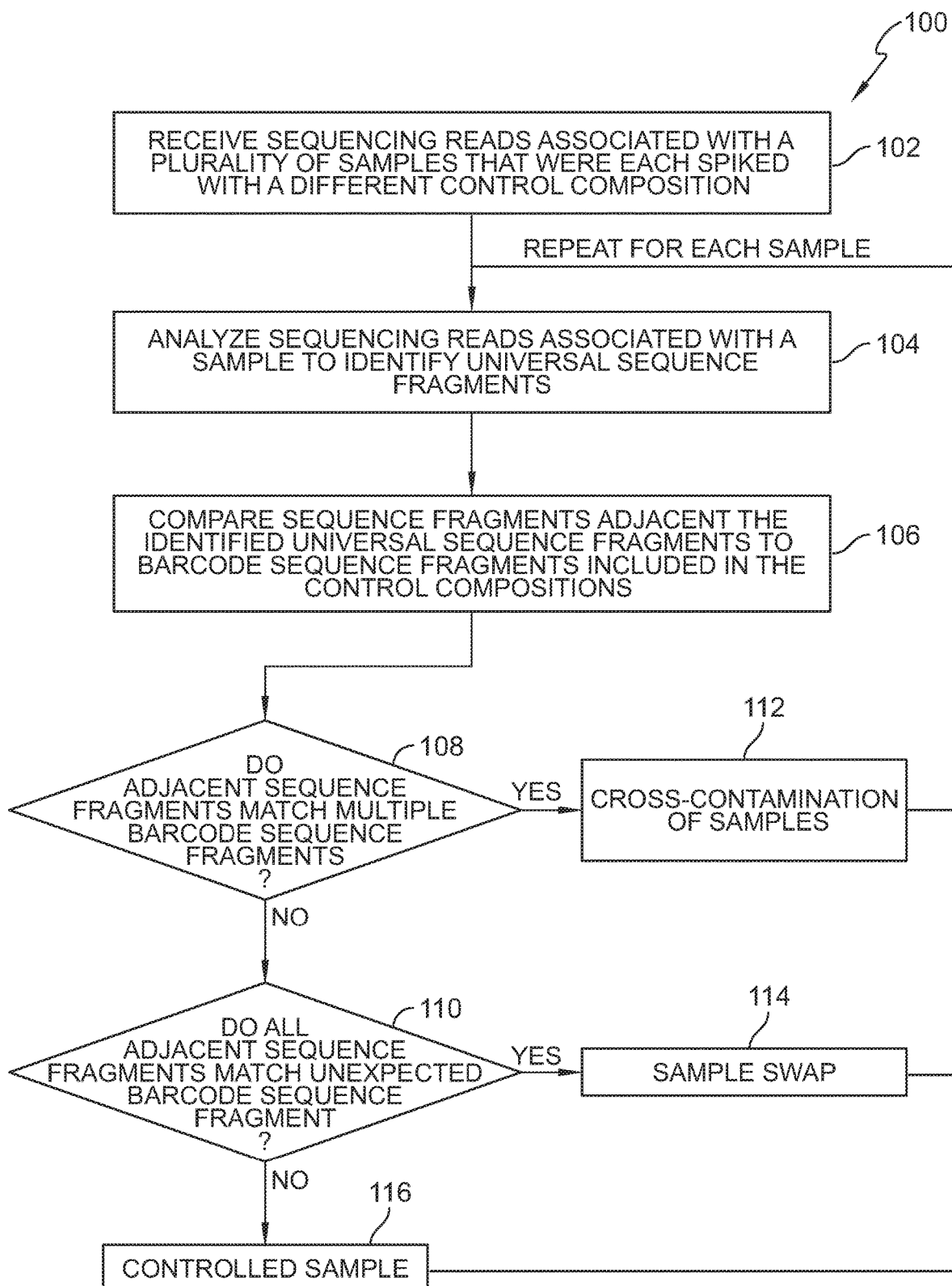
FIG. 9 is a simplified flow diagram illustrating one embodiment of a method for detecting cross-contamination or sample swapping using the presently disclosed control compositions.

Referring now to FIG. 9, an illustrative embodiment of a method 100 for detecting cross-contamination or sample swapping using the presently disclosed control compositions is shown as a simplified flow diagram. The method 100 may be performed by a computing device and, more particularly, a processor of a computing device. As shown in FIG. 9, the method 100 includes a number of steps illustrated as blocks 102-110. It will be appreciated by those of skill in the art that, in other embodiments of the method 100, not all of the blocks 102-110 need be included, the blocks 102-110 may be executed in a different order than that shown in FIG. 9 and described below, and additional or different blocks, other than those shown in FIG. 9, may be included.

In the illustrative embodiment, the method 100 begins with block 102 in which a computing device receives sequencing reads associated a plurality of samples. The sequencing reads received in block 102 will typically have been generated during multiplex sequencing of the plurality of samples. As discussed above, each of the plurality of samples is spiked with a different control composition comprising a different nucleic acid construct, with each different nucleic acid construct comprising a different barcode sequence fragment, to allow for monitoring cross-contamination or sample swapping over all steps of a DNA sequencing protocol being applied to the plurality of samples. As such, the sequencing reads received in block 102 will include sequencing reads of the DNA found in each sample and DNA from the nucleic acid constructs of the control compositions spiked into the samples. Each sequencing read is associated with the sample from which it was read, either by the use of a tag or by grouping in a distinct data structure. Block 102 may involve receiving the sequencing reads in the form of one or more FASTA, FASTQ, or similar files.

After block 102, the method 100 proceeds to block 104 in which the computing device analyzes the sequencing reads associated with a particular sample to identify the presence of one or more universal sequence fragments. As discussed above, universal sequence fragments may be linked to the 5' end and/or the 3' end of the barcode sequence fragment to assist the bioinformatic software in locating and processing the barcode sequence fragments found in the nucleic acid constructs of the control compositions. In some embodiments, block 104 may involve using a text-matching algorithm to identify the presence of one or more universal sequence fragments in the sequencing reads. By way of example, if a 10-base pair universal sequence fragment is included in the nucleic acid constructs of the control compositions, block 104 may involve utilizing a text-matching algorithm to compare each string of 10 characters present in the sequencing reads to the 10 characters representing that 10-base pair universal sequence fragment. In some embodiments, block 104 may also involve referencing a database of universal sequence fragments that may be included in the nucleic acid constructs of the control compositions. In such embodiments, each text string present in the sequencing reads being analyzed may be compared to each of the text strings representing a universal sequence fragment in the database to identify any matches.

After block 104, the method 100 proceeds to block 106 in which the computing device compares sequence fragments that are adjacent the universal sequence fragments identified in block 104 to the barcode sequence fragments included in the nucleic acid constructs of the control compositions spiked into the samples. In some embodiments, where the barcode sequence fragments are linked to two universal sequence fragments (one at the 5' end of the barcode sequence fragment and another at the 3' end of the barcode sequence fragment), block 106 may involve comparing each sequence fragment located between two universal sequence fragments in a sequencing read (identified in block 104) to the barcode sequence fragments included in the nucleic acid constructs of the control compositions. In some embodiments, block 106 may involve using a text-matching algorithm to identify the barcode sequence fragment adjacent the universal sequence fragment(s). By way of example, block 106 may involve utilizing a text-matching algorithm to compare the text string representing the sequence fragment adjacent the universal sequence fragment(s) to a plurality of text strings representing the different barcode sequence fragments included in the nucleic acid constructs of the control compositions spiked into the samples. In some embodiments, block 106 may involve referencing a database of barcode sequence fragments that may be included in the nucleic acid constructs of the control compositions for this purpose.

After block 106, the method 100 proceeds to block 108 in which the computing device determines whether the sequence fragments analyzed in block 106 collectively match multiple barcode sequence fragments included in the nucleic acid constructs of the control compositions spiked into the samples. If no cross-contamination between samples has occurred, all of the barcode sequence fragments found in the sequencing reads associated with a particular sample will be identical and match only the barcode sequence fragment included in the nucleic acid construct of the control composition spiked into that sample. As such, if block 108 determines that the sequence fragments analyzed in block 106 collectively match multiple barcode sequence fragments, the method 100 proceeds to block 112 in which the computing device identifies a cross-contamination condition. If block 108 determines that all of the sequence fragments analyzed in block 106 are identical, the method 100 instead proceeds to block 110.

In block 110 of the method 100, the computing device determines whether the sequence fragments analyzed in block 106 all match an unexpected barcode sequence fragment included in the nucleic acid constructs of the control compositions spiked into the samples. The sequencing reads associated with each sample will be expected to include a particular barcode sequence fragment based upon the nucleic acid construct of the control composition spiked into that sample. As such, if block 110 determines that the sequence fragments analyzed in block 106 all match an unexpected barcode sequence fragment, the method 100 proceeds to block 114 in which the computing device identifies a sample swap condition. If block 110 determines that all of the sequence fragments analyzed in block 106 are identical and match the expected barcode sequence fragment, the method 100 instead proceeds to block 116 in which the computing device identifies a (normal) controlled sample condition.

After reaching any of blocks 112, 114, or 116 for each sample, the method returns to block 104 and repeats blocks 104-116 for the sequencing reads associated with another sample of the plurality of samples. This process repeats until the sequencing reads associated with each of the plurality of samples has been analyzed. As such, at the conclusion of the method 100, each of the plurality of samples will have been identified as subject to a cross-contamination condition, a sample swap condition, or a controlled sample condition.

Figure 10:
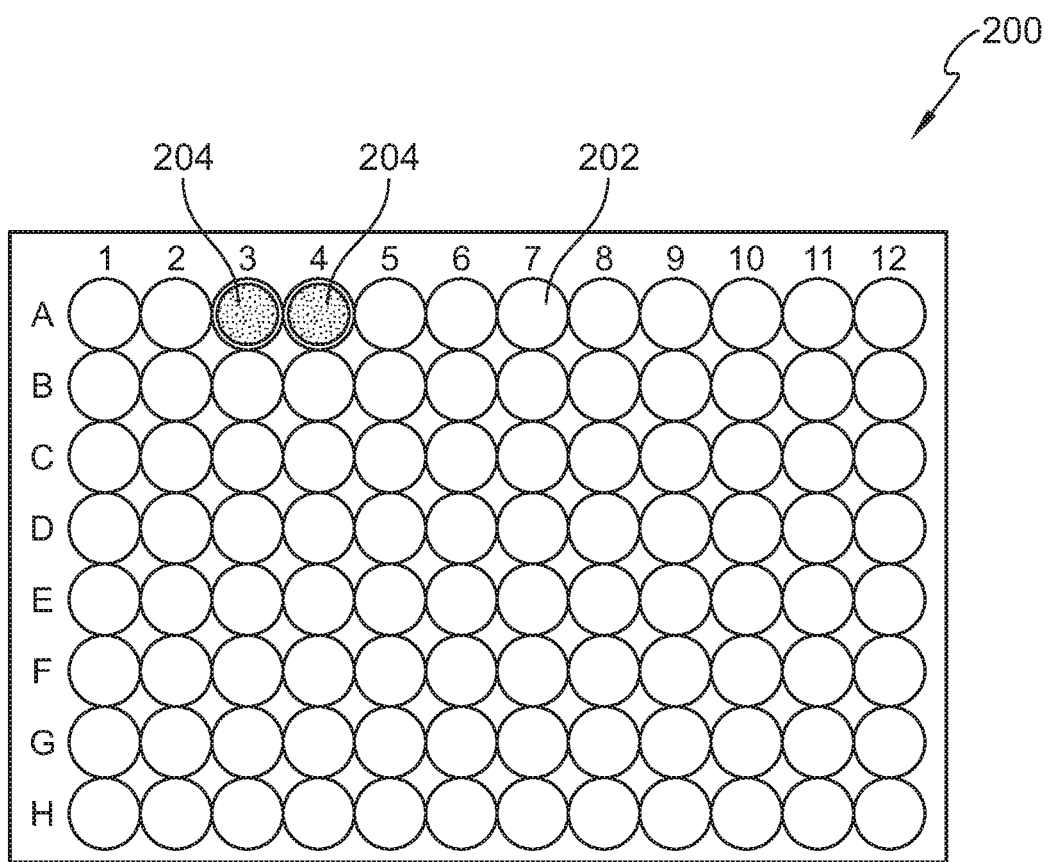
FIG. 10 is one embodiment of a graphic for displaying the results of the method of FIG. 9. Wells that have cross contamination are highlighted. This type of visual aid would enable researchers to identify cross-contamination or sample swapping, and to decide if a full plate will need to be re-run or only a few wells. The darker color in wells 3 and 4 indicates cross-contamination between wells A3 and A4.

FIG. 10 illustrates a simple graphic 200 that may be used for displaying the results of the method 100. In the illustrative embodiment shown in FIG. 10, the graphic 200 appears as a top-down view of 96-well sample plate. As will be appreciated by those skilled in the art, such samples plates are commonly used for multiplex processing and sequencing of a plurality of samples. In FIG. 10, the graphic 200 includes 96 icons 202, 204 (only three of which are labelled for clarity), with each icon 202, 204 representing one of the wells of a 96-well sample plate. It is contemplated that, in other embodiments, the graphic 200 may include greater or fewer icons 202, 204 to represent larger or smaller sample plates and/or a different number of samples being processed.

For each sample identified as subject to a controlled sample condition by the method 100, the graphic 200 includes a first icon 202 at a location corresponding to the well containing that sample. For each sample identified as subject to a cross-contamination condition by the method 100, the graphic 200 includes a second icon 204 at a location corresponding to the well containing that sample. For each sample identified as subject to a sample swap condition by the method 100, the graphic 200 may include a third icon (not shown) at a location corresponding to the well containing that sample. The first icon 202, second 204, and third icon may each be visually distinct from one another, allowing a user observing graphic 200 to quickly identify which samples are subject to which conditions. It is contemplated that in some embodiments, the graphic 200 may provide additional information on each sample, particularly in response to user interaction with the graphic 200. For instance, where a user clicks on and/or hovers over one of the icons 202, 204 with a mouse pointer, the graphic 200 may display additional information related to the sample represented by that icon, such as the barcode sequence fragment(s) found in that sample and their amounts (e.g., in number of reads or percentage of total reads).

The following examples are for illustrative purposes only. The examples are not intended to limit the invention in any way.

Example 1

Protocol for Use of Control Compositions for Sequencing

The goal was to encapsulate the CCC-1 and CCC-2 DNA (see description below) in a synthetic cell wall-like membrane that would mimic a natural bacterium, and to verify the encapsulation through spectrophotometric analysis (UV absorbance, or fluorescence), and then to test the encapsulated CCC-1 and CCC-2 DNA molecules for use as control compositions for sequencing (as described herein) in a spiked soil sample using amplicon sequencing.

Encapsulation Protocol

The Thin Film Hydration method is a viable liposome production method due to its applicability to the small volumes used for pDNA (plasmid DNA—CCC-1 and CCC-2 DNA) samples. Stock pDNA (plasmid DNA—CCC-1 and CCC-2 DNA) was purchased (see below), and only 5 µL of pDNA (at 10 µg/mL) is required for an amplicon sequencing test. The thin film hydration method (without extrusion) yields a small volume of liposomes with good yield.

Materials

| Item | Abbr. |
|---|---|
| Dipalmitoyl-sn-glycero-3-phosphocholine (DPPC) | DPPC |
| Cholesterol | CHOL |
| 1,2-dipalmitoyl-sn-glycero-3-phosphoethanolamine-N-[methoxy(poly(ethylene glycol))]- 2000] (ammonium salt) | DPPE-PEG |
| Lipopolysaccharides (rough strains) from *Escherichia coli* EH100 (Ra mutant) | LPS-Ra |

The encapsulation methods involved generating a standard calibration curve of pDNA in a UV transparent 96-well plate and reading the absorbance at 260 nm. To a micro-vial, 781 µL of ethanol was added. Then 16 µL of pDNA at 841 mg/mL (i.e. ng/µL) was added. The resulting solution was 98% ethanol with 20 µg/mL pDNA. This is the standard solution. CCC-1 and CCC-2 DNA was quantitated as described in FIG. 1 before encapsulation.

200 µL of ethanol was then added to wells B-H of columns 1 and 2 of a 96-well plate. Then 400 µL of the pDNA standard solution was added to well A of columns 1 and 2 of the plate. A 2-fold, 8-step serial dilution was performed, leaving row H as pure ethanol. The absorbance at 260 nm was then read.

To three separate 1-dram glass vials, the mass of lipids shown in Table 8 below was weighed. The actual masses were recorded and the required volume of chloroform was calculated to bring each lipid solution to its target concentration. The required volume of chloroform to add is shown under Vol solvent, add. Then the three lipid solutions were mixed by combining 1.25 mL of each in a single container.

TABLE 8

| Lipid Type | Target mass, $M_{Target}$ (mg) | Target Concentration, $C_{Target}$ (mg/mL) | Actual Mass, $M_{Actual}$ (mg) | $V_{solvent, add}$ (mL) | $V_{stock, add}$ (mL) |
|---|---|---|---|---|---|
| DPPC | 30.9 | 24.701 | 32.5 | 1.316 | 1.25 |
| CHOL | 9.5 | 7.590 | 11 | 1.449 | 1.25 |
| PEG 2000 | 9.6 | 7.710 | 11.6 | 1.505 | 1.25 |
| Chloroform | | | | | 1.25 |

The lipid solution was added to the round bottom flask and the chloroform was removed to yield a thin film. To a 1-dram glass vial, 2.5 mL of Tris-EDTA buffer was added. Then 59 µL of pDNA at 841.7 µg/mL (i.e. ng/µL) was added to the vial, and vortexed briefly to disperse the DNA. Then the pDNA solution (2.5 mL) was added to the flask, and the flask was vortexed at room temperature until the lipid film dissolved. This yielded a white turbid dispersion of pDNA encapsulated in liposomes. The solution was stored in the refrigerator until use.

Spike-In Protocol

Each 0.25 gram soil sample was spiked with either 12.5 ng of CCC-1 DNA, CCC-2 DNA, or a mixture of CCC-1 and CCC-2 DNA, encapsulated as described above. The average size of the encapsulated CCC-1 DNA or CCC-2 DNA (each include a plasmid) was 8±2 µm in diameter, and encapsulation efficiency was demonstrated to be ~85%. The CCC-1 and CCC-2 DNA molecules are plasmids comprising a barcode sequence fragment and were purchased from Blue Heron, Bothell, Wash. 98021. The CCC-1 DNA and CCC-2 DNA sequences, including the plasmid, are shown below as SEQ ID NOS:769 and 770, respectively. The nucleic acid construct sequence within the CCC-1 DNA and CCC-2 DNA sequences are shown below as SEQ ID NOS:771 and 772, respectively.

(SEQ ID NO: 769)
gtaacactggcagagcattacgctgacttgacgggacggcgcaagctcat gaccaaaatcccttaacgtgagttttcgttccactgagcgtcagacccg tagaaaagatcaaaggatcttcttgagatcctttttttctgcgcgtaatc tgctgcttgcaaacaaaaaaaccaccgctaccagcggtggatgatgccgg atcaagagctaccaactcataccgaaggtaactggcttcagctcttatgg -continued tttcccaagctgcggtatcattgcagcactggggccagatggtaagccct cccgtatcgtagttatctacacgacggggagtcaggcaactatggatgaa cgaaatagacagatcgctgagataggtgcctcactgattaagcattggta actgtcagaccaagtttactcatatatacatagattgatttaaaacttca tattaatttaaaaggatctaggtgaagatccatttgataatctcatgacc aaaatcccttaacgtgagattcgaccactgagcgtcagaccccgtagaaa agatcaaaggatcacttgagatcattattctgcgcgtaatctgctgcttg caaacaaaaaaaccaccgctaccagcggtggatgatgccggatcaagagc taccaactattaccgaaggtaactggcttcagcagagcgcagataccaaa tactgttcttctagtgtagccgtagttaggccaccacttcaagaactctg tagcaccgcctacatacctcgctctgctaatcctgttaccagtggctgct gccagtggcgataagtcgtgtcttaccgggttggactcaagacgatagtt accggataaggcgcagcggtcgggctgaacggggggacgtgcacacagcc cagatggagcgaacgacctacaccgaactgagatacctacagcgtgagct atgagaaagcgccacgcacccgaagggagaaaggcggacaggtatccgt aagcggcagggtcggaacaggagagcgcacgagggagcttccaggggaa acgcctggtatctttatagtcctgtcgggtttcgccacctctgacttgag cgtcgatttttgtgatgctcgtcagggggcggagcctatggaaaaacgc cagcaacgcggccatttacggacctggccattgctggccattgctcacat gactacctgcgttatcccctgattctgtggataaccgtattaccgcattg agtgagctgataccgctcgccgcagccgaacgaccgagcgcagcgagtca gtgagcgaggaagcggaagagcgcccaatacgcaaaccgcctctccccgc gcgttggccgattcattaatgcagctggcacgacaggtttcccgactgga aagcgggcagtgagcgcaacgcaattaatgtgagttagctcactcattag gcaccccaggattacactttatgcttccggctcgtatgttgtgtggaatt gtgagcggataacaatttcacacaggaaacagctatgaccatgattacgc caagctgcgatccggatctggatccagatcgggatctggatcaagcagga tcctatctcattccctacgggaggcatcaggcagatctcgtcccagtctc cacgagactgattagtcagtcagccggattagataccctagtagtcgaaa gttgagaccatggaattcgatctggatcttgatccggatcacgatctcga tcaattcactggccgtcgattacaacgtcgtgactgggaaaaccctggcg ttacccaacttaatcgccttgcagcacatccccattcgccagctggcgta atagcgaagaggcccgcaccgatcgccatcccaacagagcgcagcctgaa tggcgaatggcgcctgatgcggtattactccttacgcatctgtgcggtat ttcacaccgcatacgtcaaagcaaccatagtacgcgccctgtagcggcgc attaagcgcggcgggtgtggtggttacgcgcagcgtgaccgctacacttg ccagcgccttagcgcccgctcattcgattcaccatcctactcgcacgtt cgccggcatcccgtcaagctctaaatcggggggctcccataggggaccgat ttagtgattacggcacctcgaccccaaaaaacttgatttgggtgatggtt cacgtagtgggccatcgccctgatagacggtattcgcccatgacgaggag -continued tccacgttattaatagtggactatgaccaaactggaacaacactcaactc tatctcggtcttatggtacccaagctggcctcgtgatacgcctatttta taggttaatgtcatgggggggggggggaaagccacgttgtgtctcaaaat ctctgatgttacattgcacaagataaaaatatatcatcatgaacaataaa actgtctgcttacataaacagtaatacaaggggtgttatgagccatattc aacgggaaacgtcgaggccgcgattaaattccaacatggatgctgattta tatgggtataaatgggctcgcgataatgtcgggcaatcaggtgcgacaat ctatcgcttgtatgggaagcccgatgcgccagagttgtttctgaaacatg gcaaaggtagcgttgccaatgatgttacagatgagatggtcagactaaac tggctgacggaatttatgcctcaccgaccatcaagcatatatccgtactc ctgatgatgcatggttactcaccactgcgatccccggaaaaacagcattc caggtattagaagaatatcctgattcaggtgaaaatattgagatgcgctg gcagtgacctgcgccggagcattcgattcctgatgtaattgtccattaac agcgatcgcgtatttcgtcttgctcaggcgcaatcacgaatgaataacgg tttggttgatgcgagtgattttgatgacgagcgtaatgctggcctgaga acaagtctggaaagaaatgcataaacattgccattctcaccggattcagt cgtcactcatggtgatactcacttgataaccttatattgacgagggaaa ttaataggttgtattgatgttggacgagtcggaatcgcagaccgatacca ggatcttgccatcctatggaactgcctcggtgagattctcatcattacag aaacggctattcaaaaatatggtattgataatcctgatgtgaataaattg cagtttcatttgatgctcgatgagttttctaatcagaattggttaattg gtt (SEQ ID NO: 770)

gtaacactggcagagcattacgctgacttgacgggacggcgcaagctcat gaccaaaatcccttaacgtgagttttcgttccactgagcgtcagaccccg tagaaaagatcaaaggatcttcttgagatcctttttttctgcgcgtaatc tgctgcttgcaaacaaaaaaaccaccgctaccagcggtggatgatgccgg atcaagagctaccaactcataccgaaggtaactggcttcagctcttatgg tttcccaagctgcggtatcattgcagcactggggccagatggtaagccct cccgtatcgtagttatctacacgacggggagtcaggcaactatggatgaa cgaaatagacagatcgctgagataggtgcctcactgattaagcattggta actgtcagaccaagtttactcatatatacatagattgatttaaaacttca tattaatttaaaaggatctaggtgaagatccatttgataatctcatgacc aaaatcccttaacgtgagattcgaccactgagcgtcagaccccgtagaaa agatcaaaggatcacttgagatcattattctgcgcgtaatctgctgcttg caaacaaaaaaaccaccgctaccagcggtggatgatgccggatcaagagc taccaactattaccgaaggtaactggcttcagcagagcgcagataccaaa tactgttcttctagtgtagccgtagttaggccaccacttcaagaactctg tagcaccgcctacatacctcgctctgctaatcctgttaccagtggctgct gccagtggcgataagtcgtgtcttaccgggttggactcaagacgatagtt accggataaggcgcagcggtcgggctgaacggggggacgtgcacacagcc -continued

```
cagatggagcgaacgacctacaccgaactgagatacctacagcgtgagct
atgagaaagcgccacgcacccgaagggagaaaggcggacaggtatccggt
aagcggcagggtcggaacaggagagcgcacgagggagcttccaggggaa
acgcctggtatctttatagtcctgtcgggtttcgccacctctgacttgag
cgtcgattttttgtgatgctcgtcaggggggcggagcctatggaaaaacgc
cagcaacgcggccatttacggacctggccttttgctggccttttgctcac
atgttctttcctgcgttatccctgattctgtggataaccgtattaccgc
attgagtgagctgataccgctcgccgcagccgaacgaccgagcgcagcga
gtcagtgagcgaggaagcggaagagcgcccaatacgcaaaccgcctctcc
ccgcgcgttggccgattcattaatgcagctggcacgacaggtttcccgac
tggaaagcgggcagtgagcgcaacgcaattaatgtgagttagctcactca
ttaggcaccccaggattacactttatgcttccggctcgtatgttgtgtgg
aattgtgagcggataacaatttcacacaggaaacagctatgaccatgatt
acgccaagctgcgatccggatctggatccagatcgggatctggatcaagc
ttggatcctatctcctttccctacgggaggcatcaggcagatctcggctg
tacggattatcaccaggtgtagtcagtcagccggattagatacccctagta
gtcgaaagttgagaccatggaattcgatctggatcttgatccggatcacg
atctcgatcaattcactggccgtcgattacaacgtcgtgactgggaaaac
cctggcgttacccaacttaatcgccttgcagcacatccccattcgccagc
tggcgtaatagcgaagaggcccgcaccgatcgccatcccaacagagcgca
gcctgaatggcgaatggcgcctgatgcggtattactccttacgcatctgt
gcggtatttcacaccgcatacgtcaaagcaaccatagtacgcgccctgta
gcggcgcattaagcgcggcgggtgtggtggttacgcgcagcgtgaccgct
acacttgccagcgccttagcgcccgctcattcgattcaccatcctactcg
ccacgttcgccggcatcccgtcaagctctaaatcgggggctcccatagg
gaccgatttagtgattacggcacctcgaccccaaaaaacttgatttgggt
gatggttcacgtagtgggccatcgccctgatagacggtattcgcccatga
cgaggagtccacgttattaatagtggactatgaccaaactggaacaacac
tcaactctatctcggtcttatggtacccaagctggcctcgtgatacgcct
atttttataggttaatgtcatgggggggggggggaaagccacgttgtgtc
tcaaaatctctgatgttacattgcacaagataaaaatatatcatcatgaa
caataaaactgtctgcttacataaacagtaatacaagggggtgttatgagc
catattcaacgggaaacgtcgaggccgcgattaaattccaacatggatgc
tgatttatatgggtataaatgggctcgcgataatgtcgggcaatcaggtg
cgacaatctatcgcttgtatgggaagcccgatgcgccagagttgtttctg
aaacatggcaaaggtagcgttgccaatgatgttacagatgagatggtcag
actaaactggctgacggaatttatgcctcaccgaccatcaagcatatatc
cgtactcctgatgatgcatggttactcaccactcgcatccccggaaaaac
agcattccaggtattagaagaatatcctgattcaggtgaaaatattgaga
tgcgctggcagtgacctgcgccggagcattcgattcctgatgtaattgtc
cattaacagcgatcgcgtatttcgtcttgctcaggcgcaatcacgaatga
```

```
ataacggtttggttgatgcgagtgattttgatgacgagcgtaatggctgg
cctgagaacaagtctggaaagaaatgcataaacattgccattctcaccgg
attcagtcgtcactcatggtgatactcacttgataaccttatattgacga
ggggaaattaataggttgtattgatgttggacgagtcggaatcgcagacc
gataccaggatcttgccatcctatggaactgcctcggtgagattctcatc
attacagaaacggctattcaaaaatatggtattgataatcctgatgtgaa
taaattgcagtttcatttgatgctcgatgagttttttctaatcagaattgg
ttaattggtt
```

(SEQ ID NO: 771)
CCTACGGGAGGCATCAGGCAGATCTCGTCCCTTGTCTCCACGAGACTGAT
TAGTCAGTCAGCCGGATTAGATACCCTAGTAGTC (SEQ ID NO: 772)
CCTACGGGAGGCATCAGGCAGATCTCGGCTGTACGGATTATCACCAGGTG
TAGTCAGTCAGCCGGATTAGATACCCTAGTAGTC

Extraction and Purification Protocol

The DNA in the spiked soil samples was then extracted using the Qiagen DNeasy PowerSoil Kit™. The Agilent Bioanalyzer confirmed that samples contained amplicon products from both the soil microorganisms of the sample and the nucleic acid construct described herein, based on the different amplicon sizes: 16S (soil sample)=~600 bp and the nucleic acid construct=200 bp (FIGS. 2A and B).

Library Preparation and Sequencing Protocol

Figure 3A:
FIGS. 3A-C show the Krona plot of all soil bacteria present in the CCC-1 DNA-spiked sample (FIG. 3A), the CCC-2 DNA spiked sample (FIG. 3B), and the CCC-1 and CCC-2 DNA mixed spiked sample (FIG. 3C). The figures demonstrate that the spike-in controls do not interfere with the target (i.e., bacterial DNA) amplification or sequencing.
Figure 3B:
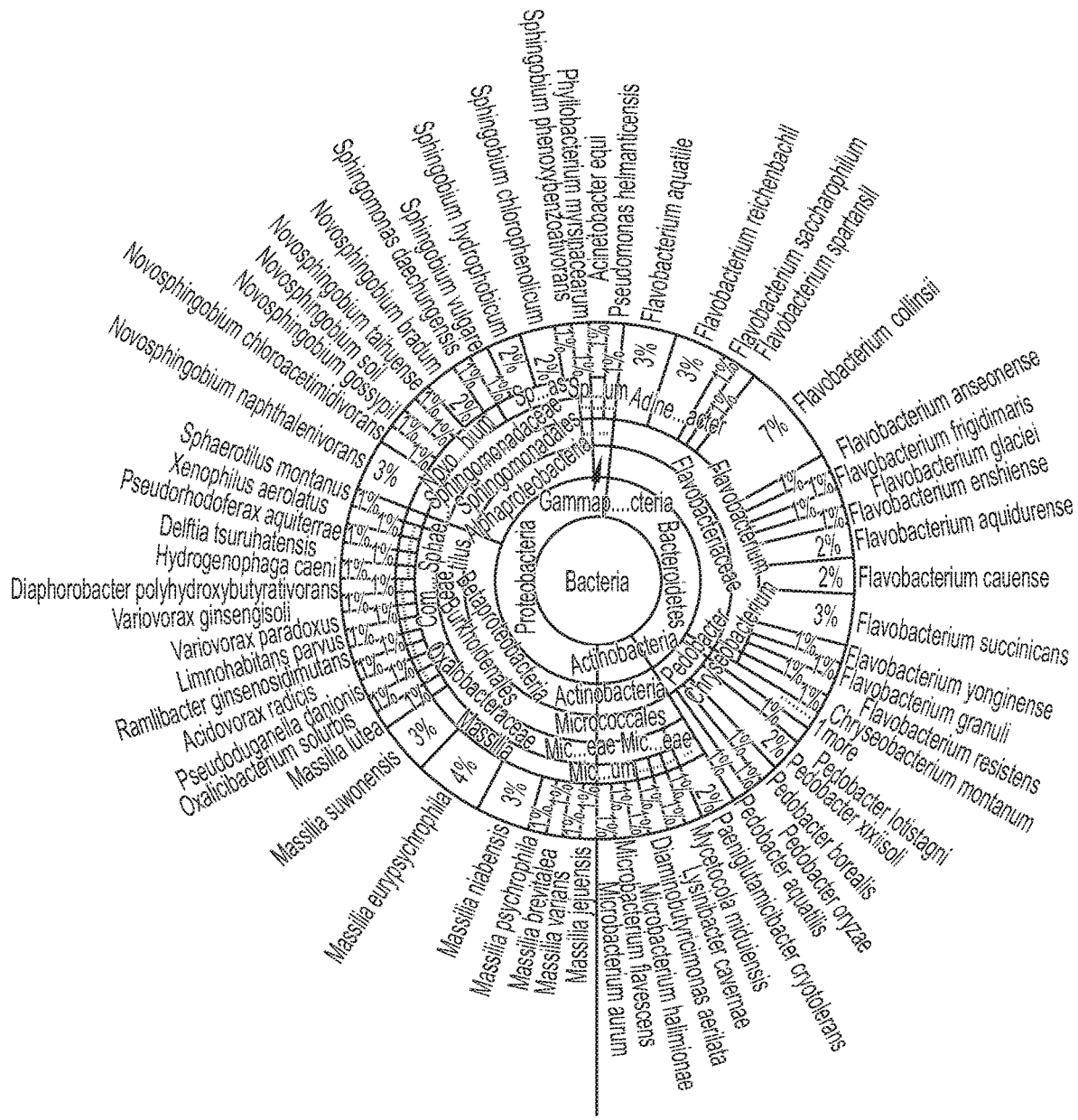
Figure 3C:
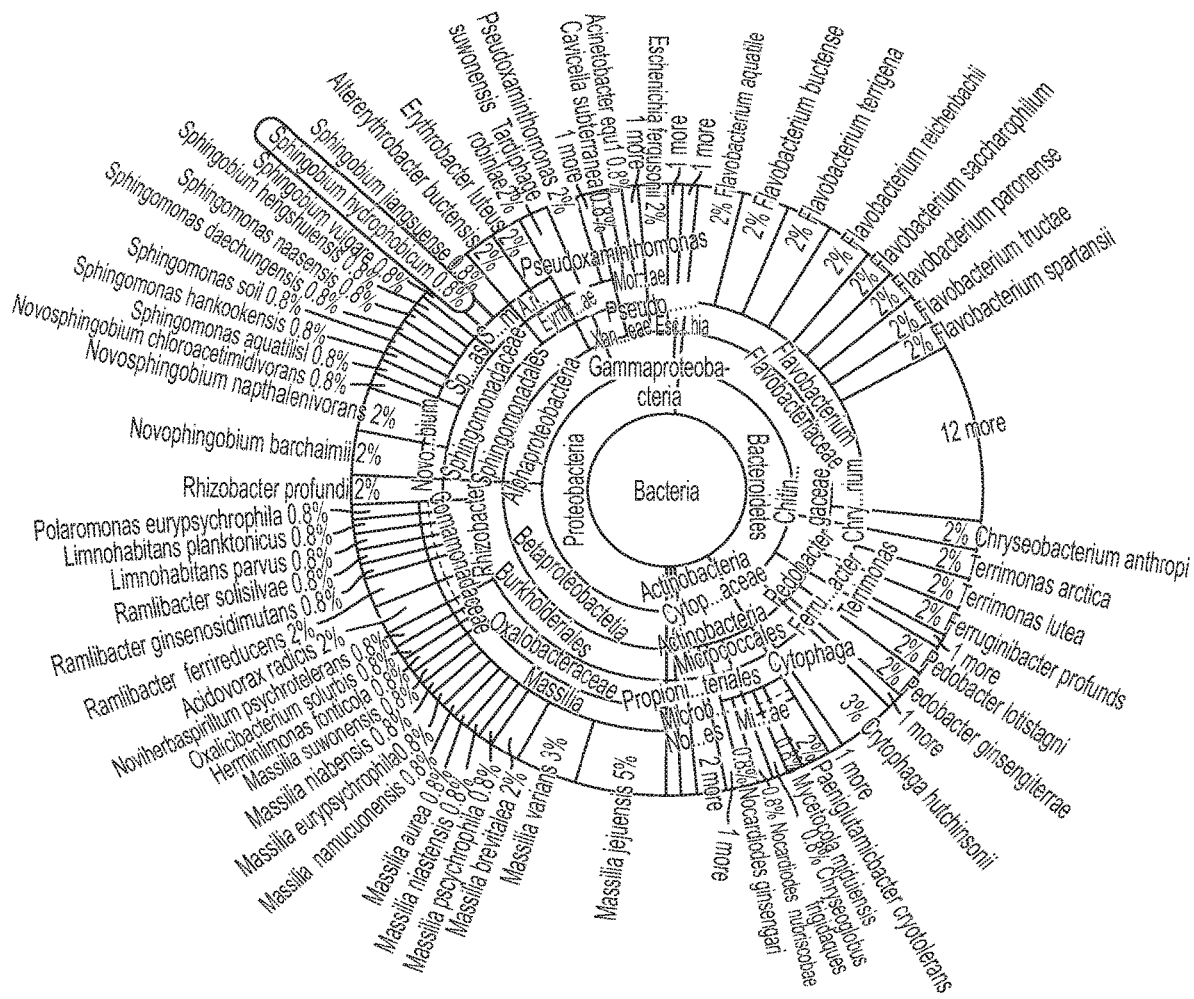

The 16S DNA was amplified and prepared for Illumina NGS sequencing on an Illumina MiSeq. The bead based clean-ups were replaced with MinElute PCR clean up columns. After library preparation, the libraries were visualized on the Agilent Bioanalyzer using the DNA High Sensitivity Assay to check the amplification and size. The libraries were then sequenced on an Illumina MiSeq 300 cycle nanoflow cell. The data was processed and sequencing results showed that the expected microorganisms (FIGS. 3A and B), and both nucleic acid constructs comprising barcode sequence fragments (within CCC-1 DNA and CCC-2 DNA; FIG. 4) were successfully sequenced and present in their specific samples.

Figure 2A:
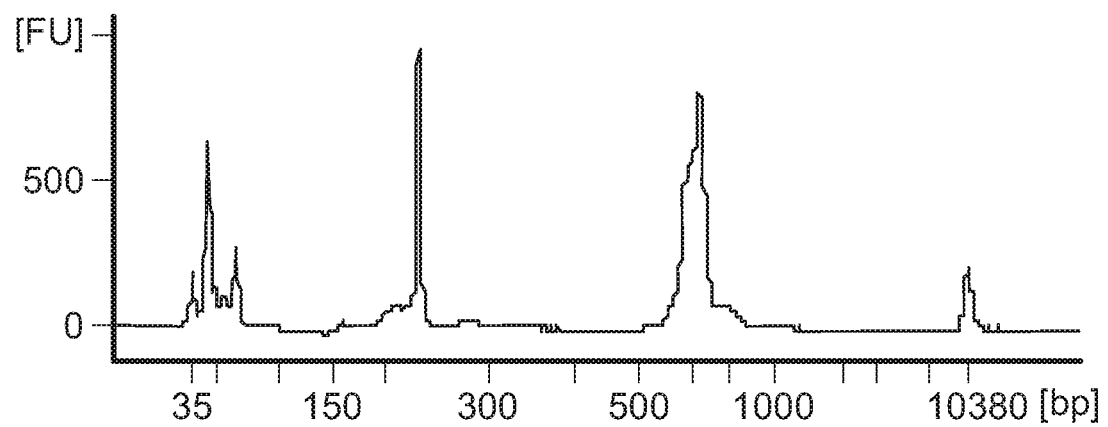
FIGS. 2A-B show the bioanalyzer results of CCC-1 DNA spike-in controls post soil extraction and library preparation (FIG. 2A) and the bioanalyzer results of CCC-1 DNA and CCC-2 DNA (for a description see Example 1) mixed spike-in controls post soil extraction and library preparation (FIG. 2B). Barcoded DNA peaks for the CCC-1 DNA and CCC-2 DNA controls can be seen at ~200 bp and 16S soil sample DNA libraries can be seen ~600 bp.
Figure 2B:
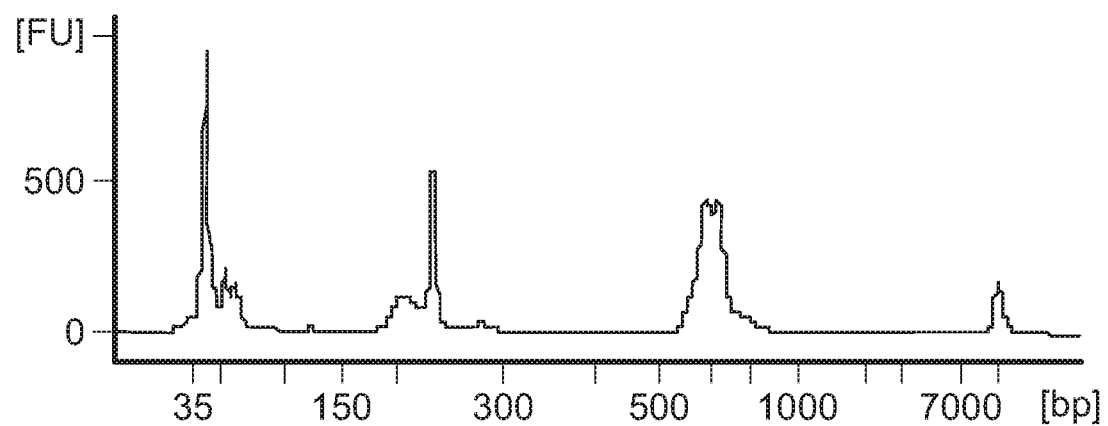

The data shown in FIGS. 2A and B, 3A, B, and C, and 4 are from soil sample DNA extraction assays where the spike-in protocol, the DNA extraction protocol, and the library preparation and sequencing protocols were performed according to the general protocols described above.

Example 2

Exemplary Scale-Up Encapsulation Protocol

Ethanol Injection Method
1. Solvent to be used is ethanol
2. Weigh lipids into 1 dram vials using Table 9 below. Target the mass in column 2 (at least). Record the actual mass in column 3. Calculate the volume of chloroform to add to each lipid as $V_{EtOH,Add}$ (mL)=$M_{Actual}$ (mg)/$[(4*M_{Target}$ (mg)/2 (mL)] and enter it in column 4 (stock volumes). The final result would be a 2 mL sample of a 10 mg/mL lipids solution with a 60:35:5 mole ratio of DPPC:Chol:PEG 2000.

TABLE 9

| Lipid Type | Target mass, $M_{Target}$ (mg) | Actual mass, $M_{Actual}$ (mg) | $V_{solvent, add}$ (mL) | $V_{stock, add}$ (mL) |
|---|---|---|---|---|
| DPPC | 12.4 | | | 0.5 |
| CHOL | 3.8 | | | 0.5 |
| PEG 2000 | 3.8 | | | 0.5 |
| LPS | 0 | | | 0 |
| EtOH | | | | 0.5 |

3. Dissolve lipids in the indicated volumes of ethanol. Then, to a 4 dram vial, add the volumes of each stock solution shown in column 5 of Table 2.
4. In a second 4 dram vial, add 2 mL of 20 mM Citrate buffer, pH 6.0.
5. Heat both to 45° C. in a water bath.
6. Draw both samples into separate 3 mL syringes and connect them to the t-connectors.
7. Using 2 syringe pumps, inject the two solutions into the t-connector a 1 mL/s (60 mL/hr). Collect the mixed solution in a stirred 4 dram vial containing 4 mL of 20 mM Citrate Buffer with 300 mM NaCl.
8. Incubate the resulting solution in a water bath at 37° C. for 30 minutes.
9. Separate the liposomes from free DNA by using sephadex columns.

Example 3

Protocol for Use of Control Compostions for Mass Spectrometry

Analytical chemistry analysis of unknown materials can be confounded by identification of compounds that do not seem to fit with what is expected. These unexpected compounds could be the result of a cross contamination event or may actually be present in the sample. Therefore, the next generation sequencing (NGS) cross contamination controls described herein were tested in a mass spectrometry protocol.

Chemical Sample Composition and Analysis

Mock chemical samples composed of 10 mL MilliQ water spiked with Cannabigerol at 10 ng/mL and Dicamba at 10 ng/mL were prepared for analysis. Two replicates (1A and 1B) were spiked with 20 μL. (240 ng) of cross contamination control 1 (CCC1). Two replicates (2A and 2B) were spiked with 20 μL (240 ng) of cross contamination control 2 (CCC2), and two replicates (3A and 3B) were spiked with 20 μL (240 ng) of CCC1 and 20 μL (240 ng) of CCC2 for a total of six samples for analysis. A negative control blank of water was also prepared and tested. A positive control spiked with Cannabigerol at 10 ng/mL and Dicamba at 10 ng/mL in water was run concurrently with the mock contamination samples. Chemical analysis was performed on a Waters Xevo TQ-XS triple quadrupole mass spectrometer following standard analytical methods for both spiked compounds. The pertinent instrument conditions are shown in Table 10.

TABLE 10

UPLC-MS/MS System Description

| UPLC | Waters Acquity |
|---|---|
| Tandem Mass Spectrometer | Waters Xevo TQ-S |
| Mass Spec Source | Electrospray, negative ion mode |
| Mass Spec Software | Waters MassLynx |
| HPLC Column | Phenomenex Prodigy ODS-3 100 Å 3 μm 2 × 100 mm |
| HPLC Column Temperature | 50° C. |
| Mobile Phase Components | A = 0.1% Formic Acid in Milli-Q Water<br>B = 0.1% Formic Acid in Acetonitrile |

| Gradient Profile | Time, min | % B | Flow rate, mL/min | Curve |
|---|---|---|---|---|
| | 0 | 90 | 0.3 | — |
| | 1 | 90 | 0.3 | 2 |
| | 6 | 10 | 0.3 | 6 |
| | 6.1 | 0 | 0.3 | 6 |
| | 7.0 | 0 | 0.3 | 6 |
| | 7.01 | 90 | 0.4 | 6 |
| | 8 | 90 | 0.4 | 1 |

| Injection Volume | 5 μL |
|---|---|
| Capillary | 0.5 kV |
| Source Temperature | 110° C. |
| Desolvation, nebulizer gas | Nitrogen @ 1000 1/hr and 600° C. |
| Collision gas | Argon @ 0.15 mL/min |
| Mass Resolution | Unit in both quadrupoles |
| Run Time | Approximately 8 min |

Ions

| Compound | Precursor | Cone (V) | Product | Collision (eV) |
|---|---|---|---|---|
| Cannabigerol | 317.2 | 30 | 69.2 | 20 |
| | | | 95.2 | 20 |
| Dicamba | 219 | 10 | 175 | 10 |
| | | | 177 | 10 |

Nucleic Acid Extraction

Encapsulated DNA from the cross-contamination control spike-in mock chemical samples were captured using a 0.22 μM nylon membrane filter (Agilent, Cat. No. R000038111) within a filtration system. The cross-contamination controls were extracted from the nylon membranes using a DNeasy PowerWater Kit (Qiagen, 14900-50-NF) and the DNA was eluted in molecular biology grade water. One tenth of the filtrate volume of 3M sodium acetate pH 5.2 was added to each filtrate. Twice the volume of the filtrate volume of ethanol (Fisher; Cat. No. BP2818-500) was added and incubated overnight at −20° C. Each sample was centrifuged at 16,000×g for 20 minutes at 4° C. and the supernatant was discarded. The DNA pellet was washed with 10 mL of 70% ethanol and centrifuged at 16,000×g for 2 minutes. The alcohol was removed, and the nucleic acid pellet air dried in a BSC until visibly dry (~15-30 minutes). The DNA pellet was suspended using the 100 μL of PowerWater DNA sample prepared using the PowerWater Kit. The extracted DNA was cleaned using a OneStep PCR Inhibitor Removal Kit (Zymo Research; Cat. No. D6030).

Sequencing

The extracted DNA samples, and a non-encapsulated CCC-1 positive control, were amplified using a KAPA HiFi Hot Start Ready Mix (KAPA Biosystems; Cat. No. 07958935001) following the Illumina 16S Metagenomic Sequencing Library Preparation guideline. The thermocycler conditions were as follows: one cycle of 95° C. for 3 minutes, 25 cycles of 95° C. for 0.5 minutes, 55° C. for 0.5 minutes, and 72° C. for 0.5 minutes; and one cycle of 72° C. for 5 minutes. The following 16S rRNA gene-specific primers coupled to Illumina adapter overhang nucleotide sequences were used:

16S Forward Primer =
(SEQ ID NO: 773)
5' TCGTCGGCAGCGTCAGATGTGTATAAGAGACAGCCTACGGGNGGCWG
CAG 3'

16S Reverse Primer =
(SEQ ID NO: 774)
5' GTCTCGTGGGCTCGGAGATGTATATAAGAGACAGGACTACHVGGGTA
TCTAATCC 3'

After amplification, the products were purified using a MinElute PCR Purification Kit (Qiagen; Cat. No. 28006) followed with a SPRISelect (Beckman Coulter; Cat. No. B23317) bead size selection (0.9X Beads). Nextera Dual-index adapters (Illumina; Cat. No. 15055293) were added to the PCR products through amplification with the KAPA HiFi Hot Start Ready Mix (KAPA Biosystems; Cat. No. 07958935001) with the following thermocycler conditions: one cycle of 95° C. for 3 minutes, 8 cycles of 95° C. for 0.5 minutes, 55° C. for 0.5 minutes, and 72° C. for 0.5 minutes; and one cycle of 72° C. for 5 minutes. The libraries were purified using a MinElute PCR Purification Kit (Qiagen; Cat. No. 28006) followed with a SPRISelect (Beckman Coulter; Cat. No. B23317) bead size selection (1.4X Beads). Libraries were quantified using a Qubit dsDNA High Sensitivity kit (Invitrogen; Cat. No. Q32854), analyzed on an Agilent High Sensitivity DNA chip (Agilent; Cat. No. 5067-4627) using a 2100 Bioanalyzer and pooled and normalized to 1 nM with 10 mM Tris-HCl (pH 8.5). Pooled library was denatured using 0.2N NaOH, neutralized with 200 mM Tris-HCl pH 7, diluted to 10 pM with hybridization buffer, and combined with 5% PhiX volume (10 pM). The denatured Phi-X and amplicon library pool was heat denatured at 96° C. before loading onto a 500 cycles MiSeq Nano Kit V2 (Cat. No. MS-103-1003) and was sequenced on an Illumina MiSeq instrument using the 250×250 bp paired-end reads.

Bioinformatics

Data files were downloaded and unzipped for analysis. Cutadapt was run to remove adapters prior to analysis. A Grep search was conducted to identify and count the custom control sequences in each file.

Results

Mock chemical samples containing Cannabigerol and Dicamba were analyzed on a Waters Xevo TQ-XS triple quadrupole mass spectrometer. The MilliQ water negative control came back blank on the MS and the chemical samples all matched the positive control showing there was no influence in the spectra from the presence of the cross-contamination controls (Table 11).

TABLE 11

Spectra results from the spiked chemical samples

| Sample | CBG Concentration (% Recovery) | Dicamba Concentration (% Recovery) |
|---|---|---|
| Blank | Not Detected | Not Detected |
| Positive Control | 8.4 ng/mL (−16.0%) | 8.3 ng/mL (−17.2%) |
| Blank | Not Detected | Not Detected |
| 1A | 14.7 ng/mL (+46.7%) | 8.9 ng/mL (−11.0%) |
| 1B | 15.4 ng/mL (+53.5%) | 8.7 ng/mL (−12.6%) |
| 2A | 12.5 ng/mL (+25.3%) | 10.7 ng/mL (+7.1%) |
| 2B | 9.2 ng/mL (−7.7%) | 10.2 ng/mL (+2.2%) |
| 3A | 9.2 ng/mL (−8.5%) | 11.0 ng/mL (+10.0%) |
| 3B | 17.5 ng/mL (+75.4%) | 11.1 ng/mL (+10.7%) |
| Blank | Not Detected | Not Detected |
| Positive Control | 11.6 ng/mL (+16.0%) | 11.7 ng/mL (+17.2%) |

Results showed acceptable variance at this concentration, which was specifically chosen to be at the lower detection limit of the mass spectrometer. There were no detectable interferences from the mock cross contamination compounds that would suppress or enhance chromatography, or otherwise influence result interpretation by an analyst.

Aliquots from each sample along with a control of CCC1 in water were prepared and sequenced. Adapter sequences, short and low-quality reads were removed prior to data analysis. The reads that passed quality control were counted for CCC1 or CCC2. The number of reads for each cross-contamination control are shown in Table 12.

TABLE 12

Read counts for each cross-contamination control

| Sample | # of CCC1 reads (%) | # of CCC2 reads |
|---|---|---|
| CCC1 | 10768 (99.5%) | 51 (0.4%) |
| 1A | 10502 (99.4%) | 67 (0.6%) |
| 1B | 1808 (99.7%) | 5 (0.2%) |
| 2A | 57 (1.0%) | 5457 (99.0%) |
| 2B | 23 (1.1%) | 1921 (98.8%) |
| 3A | 7559 (75.6%) | 2444 (24.4%) |
| 3B | 6696 (74.1%) | 2343 (25.9%) |

The results show that the cross-contamination controls spiked into the chemical samples do not interfere with chemical analysis and the controls can be detected in analytical chemistry samples when the solvent is water.

SEQUENCE LISTING (2962 sequences)

SEQ ID NO: 1 - DNA, 77 bp, Artificial Sequence
  Description of Artificial Sequence: Synthetic oligonucleotide
cctacgggaggcatcaggcagatctcgcctacgggaggcatcagagtcagtcagccggattagataccctagtagtc

SEQ ID NO: 2 - DNA, 77 bp, Artificial Sequence; identical to SEQ ID NO: 1
  Description of Artificial Sequence: Synthetic oligonucleotide

SEQ ID NO: 3 - DNA, 77 bp, Artificial Sequence; identical to SEQ ID NO: 1
  Description of Artificial Sequence: Synthetic oligonucleotide

SEQ ID NO: 4 - DNA, 77 bp, Artificial Sequence; identical to SEQ ID NO: 1
  Description of Artificial Sequence: Synthetic oligonucleotide

SEQ ID NO: 5 - DNA, 77 bp, Artificial Sequence; identical to SEQ ID NO: 1
  Description of Artificial Sequence: Synthetic oligonucleotide

SEQ ID NO: 6 - DNA, 77 bp, Artificial Sequence; identical to SEQ ID NO: 1
  Description of Artificial Sequence: Synthetic oligonucleotide

SEQ ID NO: 7 - DNA, 77 bp, Artificial Sequence; identical to SEQ ID NO: 1
  Description of Artificial Sequence: Synthetic oligonucleotide

SEQ ID NO: 8 - DNA, 77 bp, Artificial Sequence; identical to SEQ ID NO: 1
  Description of Artificial Sequence: Synthetic oligonucleotide

SEQ ID NO: 9 - DNA, 77 bp, Artificial Sequence; identical to SEQ ID NO: 1
  Description of Artificial Sequence: Synthetic oligonucleotide

SEQ ID NO: 10 - DNA, 77 bp, Artificial Sequence; identical to SEQ ID NO: 1
  Description of Artificial Sequence: Synthetic oligonucleotide

SEQ ID NO: 11 - DNA, 77 bp, Artificial Sequence; identical to SEQ ID NO: 1
  Description of Artificial Sequence: Synthetic oligonucleotide

SEQ ID NO: 12 - DNA, 77 bp, Artificial Sequence; identical to SEQ ID NO: 1
  Description of Artificial Sequence: Synthetic oligonucleotide

SEQ ID NO: 13 - DNA, 77 bp, Artificial Sequence; identical to SEQ ID NO: 1
  Description of Artificial Sequence: Synthetic oligonucleotide

SEQ ID NO: 14 - DNA, 77 bp, Artificial Sequence; identical to SEQ ID NO: 1
  Description of Artificial Sequence: Synthetic oligonucleotide

SEQ ID NO: 15 - DNA, 77 bp, Artificial Sequence; identical to SEQ ID NO: 1
  Description of Artificial Sequence: Synthetic oligonucleotide

SEQ ID NO: 16 - DNA, 77 bp, Artificial Sequence; identical to SEQ ID NO: 1
  Description of Artificial Sequence: Synthetic oligonucleotide

SEQ ID NO: 17 - DNA, 77 bp, Artificial Sequence; identical to SEQ ID NO: 1
  Description of Artificial Sequence: Synthetic oligonucleotide

SEQ ID NO: 18 - DNA, 77 bp, Artificial Sequence; identical to SEQ ID NO: 1
  Description of Artificial Sequence: Synthetic oligonucleotide

SEQ ID NO: 19 - DNA, 77 bp, Artificial Sequence; identical to SEQ ID NO: 1
  Description of Artificial Sequence: Synthetic oligonucleotide

SEQ ID NO: 20 - DNA, 77 bp, Artificial Sequence; identical to SEQ ID NO: 1
  Description of Artificial Sequence: Synthetic oligonucleotide

SEQ ID NO: 21 - DNA, 77 bp, Artificial Sequence; identical to SEQ ID NO: 1
  Description of Artificial Sequence: Synthetic oligonucleotide

SEQ ID NO: 22 - DNA, 77 bp, Artificial Sequence; identical to SEQ ID NO: 1
  Description of Artificial Sequence: Synthetic oligonucleotide

SEQ ID NO: 23 - DNA, 77 bp, Artificial Sequence; identical to SEQ ID NO: 1
  Description of Artificial Sequence: Synthetic oligonucleotide

SEQ ID NO: 24 - DNA, 77 bp, Artificial Sequence; identical to SEQ ID NO: 1
  Description of Artificial Sequence: Synthetic oligonucleotide

SEQ ID NO: 25 - DNA, 77 bp, Artificial Sequence; identical to SEQ ID NO: 1
  Description of Artificial Sequence: Synthetic oligonucleotide

SEQ ID NO: 26 - DNA, 77 bp, Artificial Sequence; identical to SEQ ID NO: 1
  Description of Artificial Sequence: Synthetic oligonucleotide

SEQ ID NO: 27 - DNA, 77 bp, Artificial Sequence; identical to SEQ ID NO: 1
  Description of Artificial Sequence: Synthetic oligonucleotide

SEQ ID NO: 28 - DNA, 77 bp, Artificial Sequence; identical to SEQ ID NO: 1
  Description of Artificial Sequence: Synthetic oligonucleotide

SEQ ID NO: 29 - DNA, 77 bp, Artificial Sequence; identical to SEQ ID NO: 1
  Description of Artificial Sequence: Synthetic oligonucleotide

SEQ ID NO: 30 - DNA, 77 bp, Artificial Sequence; identical to SEQ ID NO: 1
  Description of Artificial Sequence: Synthetic oligonucleotide

SEQ ID NO: 31 - DNA, 77 bp, Artificial Sequence; identical to SEQ ID NO: 1
  Description of Artificial Sequence: Synthetic oligonucleotide

SEQ ID NO: 32 - DNA, 77 bp, Artificial Sequence; identical to SEQ ID NO: 1
  Description of Artificial Sequence: Synthetic oligonucleotide

SEQ ID NO: 33 - DNA, 77 bp, Artificial Sequence; identical to SEQ ID NO: 1
  Description of Artificial Sequence: Synthetic oligonucleotide

SEQ ID NO: 34 - DNA, 77 bp, Artificial Sequence; identical to SEQ ID NO: 1
  Description of Artificial Sequence: Synthetic oligonucleotide

SEQ ID NO: 35 - DNA, 77 bp, Artificial Sequence; identical to SEQ ID NO: 1
  Description of Artificial Sequence: Synthetic oligonucleotide

SEQ ID NO: 36 - DNA, 77 bp, Artificial Sequence; identical to SEQ ID NO: 1
  Description of Artificial Sequence: Synthetic oligonucleotide

SEQ ID NO: 37 - DNA, 77 bp, Artificial Sequence; identical to SEQ ID NO: 1
  Description of Artificial Sequence: Synthetic oligonucleotide

SEQ ID NO: 38 - DNA, 77 bp, Artificial Sequence; identical to SEQ ID NO: 1
  Description of Artificial Sequence: Synthetic oligonucleotide

SEQ ID NO: 39 - DNA, 77 bp, Artificial Sequence; identical to SEQ ID NO: 1
  Description of Artificial Sequence: Synthetic oligonucleotide

SEQ ID NO: 40 - DNA, 77 bp, Artificial Sequence; identical to SEQ ID NO: 1
  Description of Artificial Sequence: Synthetic oligonucleotide

SEQ ID NO: 41 - DNA, 77 bp, Artificial Sequence; identical to SEQ ID NO: 1
  Description of Artificial Sequence: Synthetic oligonucleotide

SEQ ID NO: 42 - DNA, 77 bp, Artificial Sequence; identical to SEQ ID NO: 1
  Description of Artificial Sequence: Synthetic oligonucleotide

SEQ ID NO: 43 - DNA, 77 bp, Artificial Sequence; identical to SEQ ID NO: 1
  Description of Artificial Sequence: Synthetic oligonucleotide

SEQ ID NO: 44 - DNA, 77 bp, Artificial Sequence; identical to SEQ ID NO: 1
  Description of Artificial Sequence: Synthetic oligonucleotide

SEQ ID NO: 45 - DNA, 77 bp, Artificial Sequence; identical to SEQ ID NO: 1
  Description of Artificial Sequence: Synthetic oligonucleotide

SEQ ID NO: 46 - DNA, 77 bp, Artificial Sequence; identical to SEQ ID NO: 1
  Description of Artificial Sequence: Synthetic oligonucleotide

SEQ ID NO: 47 - DNA, 77 bp, Artificial Sequence; identical to SEQ ID NO: 1
  Description of Artificial Sequence: Synthetic oligonucleotide

SEQ ID NO: 48 - DNA, 77 bp, Artificial Sequence; identical to SEQ ID NO: 1
  Description of Artificial Sequence: Synthetic oligonucleotide

SEQ ID NO: 49 - DNA, 77 bp, Artificial Sequence; identical to SEQ ID NO: 1
  Description of Artificial Sequence: Synthetic oligonucleotide

SEQ ID NO: 50 - DNA, 77 bp, Artificial Sequence; identical to SEQ ID NO: 1
  Description of Artificial Sequence: Synthetic oligonucleotide

SEQ ID NO: 51 - DNA, 77 bp, Artificial Sequence; identical to SEQ ID NO: 1
  Description of Artificial Sequence: Synthetic oligonucleotide

SEQ ID NO: 52 - DNA, 77 bp, Artificial Sequence; identical to SEQ ID NO: 1
  Description of Artificial Sequence: Synthetic oligonucleotide

SEQ ID NO: 53 - DNA, 77 bp, Artificial Sequence; identical to SEQ ID NO: 1
  Description of Artificial Sequence: Synthetic oligonucleotide

SEQ ID NO: 54 - DNA, 77 bp, Artificial Sequence; identical to SEQ ID NO: 1
  Description of Artificial Sequence: Synthetic oligonucleotide

SEQ ID NO: 55 - DNA, 77 bp, Artificial Sequence; identical to SEQ ID NO: 1
  Description of Artificial Sequence: Synthetic oligonucleotide

SEQ ID NO: 56 - DNA, 77 bp, Artificial Sequence; identical to SEQ ID NO: 1
  Description of Artificial Sequence: Synthetic oligonucleotide

SEQ ID NO: 57 - DNA, 77 bp, Artificial Sequence; identical to SEQ ID NO: 1
  Description of Artificial Sequence: Synthetic oligonucleotide

SEQ ID NO: 58 - DNA, 77 bp, Artificial Sequence; identical to SEQ ID NO: 1
  Description of Artificial Sequence: Synthetic oligonucleotide

SEQ ID NO: 59 - DNA, 77 bp, Artificial Sequence; identical to SEQ ID NO: 1
  Description of Artificial Sequence: Synthetic oligonucleotide

SEQ ID NO: 60 - DNA, 77 bp, Artificial Sequence; identical to SEQ ID NO: 1
  Description of Artificial Sequence: Synthetic oligonucleotide

SEQ ID NO: 61 - DNA, 77 bp, Artificial Sequence; identical to SEQ ID NO: 1
  Description of Artificial Sequence: Synthetic oligonucleotide

SEQ ID NO: 62 - DNA, 77 bp, Artificial Sequence; identical to SEQ ID NO: 1
  Description of Artificial Sequence: Synthetic oligonucleotide

SEQ ID NO: 63 - DNA, 77 bp, Artificial Sequence; identical to SEQ ID NO: 1
  Description of Artificial Sequence: Synthetic oligonucleotide

SEQ ID NO: 64 - DNA, 77 bp, Artificial Sequence; identical to SEQ ID NO: 1
  Description of Artificial Sequence: Synthetic oligonucleotide

SEQ ID NO: 65 - DNA, 77 bp, Artificial Sequence; identical to SEQ ID NO: 1
  Description of Artificial Sequence: Synthetic oligonucleotide

SEQ ID NO: 66 - DNA, 77 bp, Artificial Sequence; identical to SEQ ID NO: 1
  Description of Artificial Sequence: Synthetic oligonucleotide

SEQ ID NO: 67 - DNA, 77 bp, Artificial Sequence; identical to SEQ ID NO: 1
  Description of Artificial Sequence: Synthetic oligonucleotide

SEQ ID NO: 68 - DNA, 77 bp, Artificial Sequence; identical to SEQ ID NO: 1
  Description of Artificial Sequence: Synthetic oligonucleotide

SEQ ID NO: 69 - DNA, 77 bp, Artificial Sequence; identical to SEQ ID NO: 1
  Description of Artificial Sequence: Synthetic oligonucleotide

SEQ ID NO: 70 - DNA, 77 bp, Artificial Sequence; identical to SEQ ID NO: 1
  Description of Artificial Sequence: Synthetic oligonucleotide

SEQ ID NO: 71 - DNA, 77 bp, Artificial Sequence; identical to SEQ ID NO: 1
  Description of Artificial Sequence: Synthetic oligonucleotide

SEQ ID NO: 72 - DNA, 77 bp, Artificial Sequence; identical to SEQ ID NO: 1
  Description of Artificial Sequence: Synthetic oligonucleotide

SEQ ID NO: 73 - DNA, 77 bp, Artificial Sequence; identical to SEQ ID NO: 1
  Description of Artificial Sequence: Synthetic oligonucleotide

SEQ ID NO: 74 - DNA, 77 bp, Artificial Sequence; identical to SEQ ID NO: 1
  Description of Artificial Sequence: Synthetic oligonucleotide

SEQ ID NO: 75 - DNA, 77 bp, Artificial Sequence; identical to SEQ ID NO: 1
  Description of Artificial Sequence: Synthetic oligonucleotide

SEQ ID NO: 76 - DNA, 77 bp, Artificial Sequence; identical to SEQ ID NO: 1
  Description of Artificial Sequence: Synthetic oligonucleotide

SEQ ID NO: 77 - DNA, 77 bp, Artificial Sequence; identical to SEQ ID NO: 1
  Description of Artificial Sequence: Synthetic oligonucleotide

SEQ ID NO: 78 - DNA, 77 bp, Artificial Sequence; identical to SEQ ID NO: 1
  Description of Artificial Sequence: Synthetic oligonucleotide

SEQ ID NO: 79 - DNA, 77 bp, Artificial Sequence; identical to SEQ ID NO: 1
  Description of Artificial Sequence: Synthetic oligonucleotide

SEQ ID NO: 80 - DNA, 77 bp, Artificial Sequence; identical to SEQ ID NO: 1
  Description of Artificial Sequence: Synthetic oligonucleotide

SEQ ID NO: 81 - DNA, 77 bp, Artificial Sequence; identical to SEQ ID NO: 1
  Description of Artificial Sequence: Synthetic oligonucleotide

SEQ ID NO: 82 - DNA, 77 bp, Artificial Sequence; identical to SEQ ID NO: 1
  Description of Artificial Sequence: Synthetic oligonucleotide

SEQ ID NO: 83 - DNA, 77 bp, Artificial Sequence; identical to SEQ ID NO: 1
  Description of Artificial Sequence: Synthetic oligonucleotide

SEQ ID NO: 84 - DNA, 77 bp, Artificial Sequence; identical to SEQ ID NO: 1
  Description of Artificial Sequence: Synthetic oligonucleotide

SEQ ID NO: 85 - DNA, 77 bp, Artificial Sequence; identical to SEQ ID NO: 1
  Description of Artificial Sequence: Synthetic oligonucleotide

SEQ ID NO: 86 - DNA, 77 bp, Artificial Sequence; identical to SEQ ID NO: 1
  Description of Artificial Sequence: Synthetic oligonucleotide

SEQ ID NO: 87 - DNA, 77 bp, Artificial Sequence; identical to SEQ ID NO: 1
  Description of Artificial Sequence: Synthetic oligonucleotide

SEQ ID NO: 88 - DNA, 77 bp, Artificial Sequence; identical to SEQ ID NO: 1
  Description of Artificial Sequence: Synthetic oligonucleotide

SEQ ID NO: 89 - DNA, 77 bp, Artificial Sequence; identical to SEQ ID NO: 1
  Description of Artificial Sequence: Synthetic oligonucleotide

SEQ ID NO: 90 - DNA, 77 bp, Artificial Sequence; identical to SEQ ID NO: 1
  Description of Artificial Sequence: Synthetic oligonucleotide

SEQ ID NO: 91 - DNA, 77 bp, Artificial Sequence; identical to SEQ ID NO: 1
  Description of Artificial Sequence: Synthetic oligonucleotide

SEQ ID NO: 92 - DNA, 77 bp, Artificial Sequence; identical to SEQ ID NO: 1
  Description of Artificial Sequence: Synthetic oligonucleotide

SEQ ID NO: 93 - DNA, 77 bp, Artificial Sequence; identical to SEQ ID NO: 1
  Description of Artificial Sequence: Synthetic oligonucleotide

SEQ ID NO: 94 - DNA, 77 bp, Artificial Sequence; identical to SEQ ID NO: 1
  Description of Artificial Sequence: Synthetic oligonucleotide

SEQ ID NO: 95 - DNA, 77 bp, Artificial Sequence; identical to SEQ ID NO: 1
  Description of Artificial Sequence: Synthetic oligonucleotide

SEQ ID NO: 96 - DNA, 77 bp, Artificial Sequence; identical to SEQ ID NO: 1
  Description of Artificial Sequence: Synthetic oligonucleotide

SEQ ID NO: 97 - DNA, 77 bp, Artificial Sequence; identical to SEQ ID NO: 1
  Description of Artificial Sequence: Synthetic oligonucleotide

SEQ ID NO: 98 - DNA, 77 bp, Artificial Sequence; identical to SEQ ID NO: 1
  Description of Artificial Sequence: Synthetic oligonucleotide

SEQ ID NO: 99 - DNA, 77 bp, Artificial Sequence; identical to SEQ ID NO: 1
  Description of Artificial Sequence: Synthetic oligonucleotide

SEQ ID NO: 100 - DNA, 77 bp, Artificial Sequence; identical to SEQ ID NO: 1
  Description of Artificial Sequence: Synthetic oligonucleotide

SEQ ID NO: 101 - DNA, 77 bp, Artificial Sequence; identical to SEQ ID NO: 1
  Description of Artificial Sequence: Synthetic oligonucleotide

SEQ ID NO: 102 - DNA, 77 bp, Artificial Sequence; identical to SEQ ID NO: 1
  Description of Artificial Sequence: Synthetic oligonucleotide

SEQ ID NO: 103 - DNA, 77 bp, Artificial Sequence; identical to SEQ ID NO: 1
  Description of Artificial Sequence: Synthetic oligonucleotide

SEQ ID NO: 104 - DNA, 77 bp, Artificial Sequence; identical to SEQ ID NO: 1
  Description of Artificial Sequence: Synthetic oligonucleotide

SEQ ID NO: 105 - DNA, 77 bp, Artificial Sequence; identical to SEQ ID NO: 1
  Description of Artificial Sequence: Synthetic oligonucleotide

SEQ ID NO: 106 - DNA, 77 bp, Artificial Sequence; identical to SEQ ID NO: 1
  Description of Artificial Sequence: Synthetic oligonucleotide

SEQ ID NO: 107 - DNA, 77 bp, Artificial Sequence; identical to SEQ ID NO: 1
  Description of Artificial Sequence: Synthetic oligonucleotide

SEQ ID NO: 108 - DNA, 77 bp, Artificial Sequence; identical to SEQ ID NO: 1
  Description of Artificial Sequence: Synthetic oligonucleotide

SEQ ID NO: 109 - DNA, 77 bp, Artificial Sequence; identical to SEQ ID NO: 1
  Description of Artificial Sequence: Synthetic oligonucleotide

SEQ ID NO: 110 - DNA, 77 bp, Artificial Sequence; identical to SEQ ID NO: 1
  Description of Artificial Sequence: Synthetic oligonucleotide

SEQ ID NO: 111 - DNA, 77 bp, Artificial Sequence; identical to SEQ ID NO: 1
  Description of Artificial Sequence: Synthetic oligonucleotide

SEQ ID NO: 112 - DNA, 77 bp, Artificial Sequence; identical to SEQ ID NO: 1
  Description of Artificial Sequence: Synthetic oligonucleotide

SEQ ID NO: 113 - DNA, 77 bp, Artificial Sequence; identical to SEQ ID NO: 1
  Description of Artificial Sequence: Synthetic oligonucleotide

SEQ ID NO: 114 - DNA, 77 bp, Artificial Sequence; identical to SEQ ID NO: 1
  Description of Artificial Sequence: Synthetic oligonucleotide

SEQ ID NO: 115 - DNA, 77 bp, Artificial Sequence; identical to SEQ ID NO: 1
  Description of Artificial Sequence: Synthetic oligonucleotide

SEQ ID NO: 116 - DNA, 77 bp, Artificial Sequence; identical to SEQ ID NO: 1
  Description of Artificial Sequence: Synthetic oligonucleotide

SEQ ID NO: 117 - DNA, 77 bp, Artificial Sequence; identical to SEQ ID NO: 1
  Description of Artificial Sequence: Synthetic oligonucleotide

SEQ ID NO: 118 - DNA, 77 bp, Artificial Sequence; identical to SEQ ID NO: 1
  Description of Artificial Sequence: Synthetic oligonucleotide

SEQ ID NO: 119 - DNA, 77 bp, Artificial Sequence; identical to SEQ ID NO: 1
  Description of Artificial Sequence: Synthetic oligonucleotide

SEQ ID NO: 120 - DNA, 77 bp, Artificial Sequence; identical to SEQ ID NO: 1
  Description of Artificial Sequence: Synthetic oligonucleotide

SEQ ID NO: 121 - DNA, 77 bp, Artificial Sequence; identical to SEQ ID NO: 1
  Description of Artificial Sequence: Synthetic oligonucleotide

SEQ ID NO: 122 - DNA, 77 bp, Artificial Sequence; identical to SEQ ID NO: 1
  Description of Artificial Sequence: Synthetic oligonucleotide

SEQ ID NO: 123 - DNA, 77 bp, Artificial Sequence; identical to SEQ ID NO: 1
  Description of Artificial Sequence: Synthetic oligonucleotide

SEQ ID NO: 124 - DNA, 77 bp, Artificial Sequence; identical to SEQ ID NO: 1
  Description of Artificial Sequence: Synthetic oligonucleotide

SEQ ID NO: 125 - DNA, 77 bp, Artificial Sequence; identical to SEQ ID NO: 1
  Description of Artificial Sequence: Synthetic oligonucleotide

SEQ ID NO: 126 - DNA, 77 bp, Artificial Sequence; identical to SEQ ID NO: 1
  Description of Artificial Sequence: Synthetic oligonucleotide

SEQ ID NO: 127 - DNA, 77 bp, Artificial Sequence; identical to SEQ ID NO: 1
  Description of Artificial Sequence: Synthetic oligonucleotide

SEQ ID NO: 128 - DNA, 77 bp, Artificial Sequence; identical to SEQ ID NO: 1
  Description of Artificial Sequence: Synthetic oligonucleotide

SEQ ID NO: 129 - DNA, 77 bp, Artificial Sequence; identical to SEQ ID NO: 1
  Description of Artificial Sequence: Synthetic oligonucleotide

SEQ ID NO: 130 - DNA, 77 bp, Artificial Sequence; identical to SEQ ID NO: 1
  Description of Artificial Sequence: Synthetic oligonucleotide

SEQ ID NO: 131 - DNA, 77 bp, Artificial Sequence; identical to SEQ ID NO: 1
  Description of Artificial Sequence: Synthetic oligonucleotide

SEQ ID NO: 132 - DNA, 77 bp, Artificial Sequence; identical to SEQ ID NO: 1
  Description of Artificial Sequence: Synthetic oligonucleotide

SEQ ID NO: 133 - DNA, 77 bp, Artificial Sequence; identical to SEQ ID NO: 1
  Description of Artificial Sequence: Synthetic oligonucleotide

SEQ ID NO: 134 - DNA, 77 bp, Artificial Sequence; identical to SEQ ID NO: 1
  Description of Artificial Sequence: Synthetic oligonucleotide

SEQ ID NO: 135 - DNA, 77 bp, Artificial Sequence; identical to SEQ ID NO: 1
  Description of Artificial Sequence: Synthetic oligonucleotide

SEQ ID NO: 136 - DNA, 77 bp, Artificial Sequence; identical to SEQ ID NO: 1
  Description of Artificial Sequence: Synthetic oligonucleotide

SEQ ID NO: 137 - DNA, 77 bp, Artificial Sequence; identical to SEQ ID NO: 1
  Description of Artificial Sequence: Synthetic oligonucleotide

SEQ ID NO: 138 - DNA, 77 bp, Artificial Sequence; identical to SEQ ID NO: 1
  Description of Artificial Sequence: Synthetic oligonucleotide

SEQ ID NO: 139 - DNA, 77 bp, Artificial Sequence; identical to SEQ ID NO: 1
  Description of Artificial Sequence: Synthetic oligonucleotide

SEQ ID NO: 140 - DNA, 77 bp, Artificial Sequence; identical to SEQ ID NO: 1
  Description of Artificial Sequence: Synthetic oligonucleotide

SEQ ID NO: 141 - DNA, 77 bp, Artificial Sequence; identical to SEQ ID NO: 1
  Description of Artificial Sequence: Synthetic oligonucleotide

SEQ ID NO: 142 - DNA, 77 bp, Artificial Sequence; identical to SEQ ID NO: 1
  Description of Artificial Sequence: Synthetic oligonucleotide

SEQ ID NO: 143 - DNA, 77 bp, Artificial Sequence; identical to SEQ ID NO: 1
  Description of Artificial Sequence: Synthetic oligonucleotide

SEQ ID NO: 144 - DNA, 77 bp, Artificial Sequence; identical to SEQ ID NO: 1
  Description of Artificial Sequence: Synthetic oligonucleotide

SEQ ID NO: 145 - DNA, 77 bp, Artificial Sequence; identical to SEQ ID NO: 1
  Description of Artificial Sequence: Synthetic oligonucleotide

SEQ ID NO: 146 - DNA, 77 bp, Artificial Sequence; identical to SEQ ID NO: 1
  Description of Artificial Sequence: Synthetic oligonucleotide

SEQ ID NO: 147 - DNA, 77 bp, Artificial Sequence; identical to SEQ ID NO: 1
  Description of Artificial Sequence: Synthetic oligonucleotide

SEQ ID NO: 148 - DNA, 77 bp, Artificial Sequence; identical to SEQ ID NO: 1
  Description of Artificial Sequence: Synthetic oligonucleotide

SEQ ID NO: 149 - DNA, 77 bp, Artificial Sequence; identical to SEQ ID NO: 1
  Description of Artificial Sequence: Synthetic oligonucleotide

SEQ ID NO: 150 - DNA, 77 bp, Artificial Sequence; identical to SEQ ID NO: 1
  Description of Artificial Sequence: Synthetic oligonucleotide

SEQ ID NO: 151 - DNA, 77 bp, Artificial Sequence; identical to SEQ ID NO: 1
  Description of Artificial Sequence: Synthetic oligonucleotide

SEQ ID NO: 152 - DNA, 77 bp, Artificial Sequence; identical to SEQ ID NO: 1
  Description of Artificial Sequence: Synthetic oligonucleotide

SEQ ID NO: 153 - DNA, 77 bp, Artificial Sequence; identical to SEQ ID NO: 1
  Description of Artificial Sequence: Synthetic oligonucleotide

SEQ ID NO: 154 - DNA, 77 bp, Artificial Sequence; identical to SEQ ID NO: 1
  Description of Artificial Sequence: Synthetic oligonucleotide

SEQ ID NO: 155 - DNA, 77 bp, Artificial Sequence; identical to SEQ ID NO: 1
  Description of Artificial Sequence: Synthetic oligonucleotide

SEQ ID NO: 156 - DNA, 77 bp, Artificial Sequence; identical to SEQ ID NO: 1
  Description of Artificial Sequence: Synthetic oligonucleotide

SEQ ID NO: 157 - DNA, 77 bp, Artificial Sequence; identical to SEQ ID NO: 1
  Description of Artificial Sequence: Synthetic oligonucleotide

SEQ ID NO: 158 - DNA, 77 bp, Artificial Sequence; identical to SEQ ID NO: 1
  Description of Artificial Sequence: Synthetic oligonucleotide

SEQ ID NO: 159 - DNA, 77 bp, Artificial Sequence; identical to SEQ ID NO: 1
  Description of Artificial Sequence: Synthetic oligonucleotide

SEQ ID NO: 160 - DNA, 77 bp, Artificial Sequence; identical to SEQ ID NO: 1
  Description of Artificial Sequence: Synthetic oligonucleotide

SEQ ID NO: 161 - DNA, 77 bp, Artificial Sequence; identical to SEQ ID NO: 1
  Description of Artificial Sequence: Synthetic oligonucleotide

SEQ ID NO: 162 - DNA, 77 bp, Artificial Sequence; identical to SEQ ID NO: 1
  Description of Artificial Sequence: Synthetic oligonucleotide

SEQ ID NO: 163 - DNA, 77 bp, Artificial Sequence; identical to SEQ ID NO: 1
  Description of Artificial Sequence: Synthetic oligonucleotide

SEQ ID NO: 164 - DNA, 77 bp, Artificial Sequence; identical to SEQ ID NO: 1
  Description of Artificial Sequence: Synthetic oligonucleotide

SEQ ID NO: 165 - DNA, 77 bp, Artificial Sequence; identical to SEQ ID NO: 1
  Description of Artificial Sequence: Synthetic oligonucleotide

SEQ ID NO: 166 - DNA, 77 bp, Artificial Sequence; identical to SEQ ID NO: 1
  Description of Artificial Sequence: Synthetic oligonucleotide

SEQ ID NO: 167 - DNA, 77 bp, Artificial Sequence; identical to SEQ ID NO: 1
  Description of Artificial Sequence: Synthetic oligonucleotide

SEQ ID NO: 168 - DNA, 77 bp, Artificial Sequence; identical to SEQ ID NO: 1
  Description of Artificial Sequence: Synthetic oligonucleotide

SEQ ID NO: 169 - DNA, 77 bp, Artificial Sequence; identical to SEQ ID NO: 1
  Description of Artificial Sequence: Synthetic oligonucleotide

SEQ ID NO: 170 - DNA, 77 bp, Artificial Sequence; identical to SEQ ID NO: 1
  Description of Artificial Sequence: Synthetic oligonucleotide

SEQ ID NO: 171 - DNA, 77 bp, Artificial Sequence; identical to SEQ ID NO: 1
  Description of Artificial Sequence: Synthetic oligonucleotide

SEQ ID NO: 172 - DNA, 77 bp, Artificial Sequence; identical to SEQ ID NO: 1
  Description of Artificial Sequence: Synthetic oligonucleotide

SEQ ID NO: 173 - DNA, 77 bp, Artificial Sequence; identical to SEQ ID NO: 1
  Description of Artificial Sequence: Synthetic oligonucleotide

SEQ ID NO: 174 - DNA, 77 bp, Artificial Sequence; identical to SEQ ID NO: 1
  Description of Artificial Sequence: Synthetic oligonucleotide

SEQ ID NO: 175 - DNA, 77 bp, Artificial Sequence; identical to SEQ ID NO: 1
  Description of Artificial Sequence: Synthetic oligonucleotide

SEQ ID NO: 176 - DNA, 77 bp, Artificial Sequence; identical to SEQ ID NO: 1
  Description of Artificial Sequence: Synthetic oligonucleotide

SEQ ID NO: 177 - DNA, 77 bp, Artificial Sequence; identical to SEQ ID NO: 1
  Description of Artificial Sequence: Synthetic oligonucleotide

SEQ ID NO: 178 - DNA, 77 bp, Artificial Sequence; identical to SEQ ID NO: 1
  Description of Artificial Sequence: Synthetic oligonucleotide

SEQ ID NO: 179 - DNA, 77 bp, Artificial Sequence; identical to SEQ ID NO: 1
  Description of Artificial Sequence: Synthetic oligonucleotide

SEQ ID NO: 180 - DNA, 77 bp, Artificial Sequence; identical to SEQ ID NO: 1
  Description of Artificial Sequence: Synthetic oligonucleotide

SEQ ID NO: 181 - DNA, 77 bp, Artificial Sequence; identical to SEQ ID NO: 1
  Description of Artificial Sequence: Synthetic oligonucleotide

SEQ ID NO: 182 - DNA, 77 bp, Artificial Sequence; identical to SEQ ID NO: 1
  Description of Artificial Sequence: Synthetic oligonucleotide

SEQ ID NO: 183 - DNA, 77 bp, Artificial Sequence; identical to SEQ ID NO: 1
  Description of Artificial Sequence: Synthetic oligonucleotide

SEQ ID NO: 184 - DNA, 77 bp, Artificial Sequence; identical to SEQ ID NO: 1
  Description of Artificial Sequence: Synthetic oligonucleotide

SEQ ID NO: 185 - DNA, 77 bp, Artificial Sequence; identical to SEQ ID NO: 1
  Description of Artificial Sequence: Synthetic oligonucleotide

SEQ ID NO: 186 - DNA, 77 bp, Artificial Sequence; identical to SEQ ID NO: 1
  Description of Artificial Sequence: Synthetic oligonucleotide

SEQ ID NO: 187 - DNA, 77 bp, Artificial Sequence; identical to SEQ ID NO: 1
  Description of Artificial Sequence: Synthetic oligonucleotide

SEQ ID NO: 188 - DNA, 77 bp, Artificial Sequence; identical to SEQ ID NO: 1
  Description of Artificial Sequence: Synthetic oligonucleotide

SEQ ID NO: 189 - DNA, 77 bp, Artificial Sequence; identical to SEQ ID NO: 1
  Description of Artificial Sequence: Synthetic oligonucleotide

SEQ ID NO: 190 - DNA, 77 bp, Artificial Sequence; identical to SEQ ID NO: 1
  Description of Artificial Sequence: Synthetic oligonucleotide

SEQ ID NO: 191 - DNA, 77 bp, Artificial Sequence; identical to SEQ ID NO: 1
  Description of Artificial Sequence: Synthetic oligonucleotide

SEQ ID NO: 192 - DNA, 77 bp, Artificial Sequence; identical to SEQ ID NO: 1
  Description of Artificial Sequence: Synthetic oligonucleotide

SEQ ID NO: 193 - DNA, 77 bp, Artificial Sequence; identical to SEQ ID NO: 1
  Description of Artificial Sequence: Synthetic oligonucleotide

SEQ ID NO: 194 - DNA, 77 bp, Artificial Sequence; identical to SEQ ID NO: 1
  Description of Artificial Sequence: Synthetic oligonucleotide

SEQ ID NO: 195 - DNA, 77 bp, Artificial Sequence; identical to SEQ ID NO: 1
  Description of Artificial Sequence: Synthetic oligonucleotide

SEQ ID NO: 196 - DNA, 77 bp, Artificial Sequence; identical to SEQ ID NO: 1
  Description of Artificial Sequence: Synthetic oligonucleotide

SEQ ID NO: 197 - DNA, 77 bp, Artificial Sequence; identical to SEQ ID NO: 1
  Description of Artificial Sequence: Synthetic oligonucleotide

SEQ ID NO: 198 - DNA, 77 bp, Artificial Sequence; identical to SEQ ID NO: 1
  Description of Artificial Sequence: Synthetic oligonucleotide

SEQ ID NO: 199 - DNA, 77 bp, Artificial Sequence; identical to SEQ ID NO: 1
  Description of Artificial Sequence: Synthetic oligonucleotide

SEQ ID NO: 200 - DNA, 77 bp, Artificial Sequence; identical to SEQ ID NO: 1
  Description of Artificial Sequence: Synthetic oligonucleotide

SEQ ID NO: 201 - DNA, 77 bp, Artificial Sequence; identical to SEQ ID NO: 1
  Description of Artificial Sequence: Synthetic oligonucleotide

SEQ ID NO: 202 - DNA, 77 bp, Artificial Sequence; identical to SEQ ID NO: 1
  Description of Artificial Sequence: Synthetic oligonucleotide

SEQ ID NO: 203 - DNA, 77 bp, Artificial Sequence; identical to SEQ ID NO: 1
  Description of Artificial Sequence: Synthetic oligonucleotide

SEQ ID NO: 204 - DNA, 77 bp, Artificial Sequence; identical to SEQ ID NO: 1
  Description of Artificial Sequence: Synthetic oligonucleotide

SEQ ID NO: 205 - DNA, 77 bp, Artificial Sequence; identical to SEQ ID NO: 1
  Description of Artificial Sequence: Synthetic oligonucleotide

SEQ ID NO: 206 - DNA, 77 bp, Artificial Sequence; identical to SEQ ID NO: 1
  Description of Artificial Sequence: Synthetic oligonucleotide

SEQ ID NO: 207 - DNA, 77 bp, Artificial Sequence; identical to SEQ ID NO: 1
  Description of Artificial Sequence: Synthetic oligonucleotide

SEQ ID NO: 208 - DNA, 77 bp, Artificial Sequence; identical to SEQ ID NO: 1
  Description of Artificial Sequence: Synthetic oligonucleotide

SEQ ID NO: 209 - DNA, 77 bp, Artificial Sequence; identical to SEQ ID NO: 1
  Description of Artificial Sequence: Synthetic oligonucleotide

SEQ ID NO: 210 - DNA, 77 bp, Artificial Sequence; identical to SEQ ID NO: 1
  Description of Artificial Sequence: Synthetic oligonucleotide

SEQ ID NO: 211 - DNA, 77 bp, Artificial Sequence; identical to SEQ ID NO: 1
  Description of Artificial Sequence: Synthetic oligonucleotide

SEQ ID NO: 212 - DNA, 77 bp, Artificial Sequence; identical to SEQ ID NO: 1
  Description of Artificial Sequence: Synthetic oligonucleotide

SEQ ID NO: 213 - DNA, 77 bp, Artificial Sequence; identical to SEQ ID NO: 1
  Description of Artificial Sequence: Synthetic oligonucleotide

SEQ ID NO: 214 - DNA, 77 bp, Artificial Sequence; identical to SEQ ID NO: 1
  Description of Artificial Sequence: Synthetic oligonucleotide

SEQ ID NO: 215 - DNA, 77 bp, Artificial Sequence; identical to SEQ ID NO: 1
  Description of Artificial Sequence: Synthetic oligonucleotide

SEQ ID NO: 216 - DNA, 77 bp, Artificial Sequence; identical to SEQ ID NO: 1
  Description of Artificial Sequence: Synthetic oligonucleotide

SEQ ID NO: 217 - DNA, 77 bp, Artificial Sequence; identical to SEQ ID NO: 1
  Description of Artificial Sequence: Synthetic oligonucleotide

SEQ ID NO: 218 - DNA, 77 bp, Artificial Sequence; identical to SEQ ID NO: 1
  Description of Artificial Sequence: Synthetic oligonucleotide

SEQ ID NO: 219 - DNA, 77 bp, Artificial Sequence; identical to SEQ ID NO: 1
  Description of Artificial Sequence: Synthetic oligonucleotide

SEQ ID NO: 220 - DNA, 77 bp, Artificial Sequence; identical to SEQ ID NO: 1
  Description of Artificial Sequence: Synthetic oligonucleotide

SEQ ID NO: 221 - DNA, 77 bp, Artificial Sequence; identical to SEQ ID NO: 1
  Description of Artificial Sequence: Synthetic oligonucleotide

SEQ ID NO: 222 - DNA, 77 bp, Artificial Sequence; identical to SEQ ID NO: 1
  Description of Artificial Sequence: Synthetic oligonucleotide

SEQ ID NO: 223 - DNA, 77 bp, Artificial Sequence; identical to SEQ ID NO: 1
  Description of Artificial Sequence: Synthetic oligonucleotide

SEQ ID NO: 224 - DNA, 77 bp, Artificial Sequence; identical to SEQ ID NO: 1
  Description of Artificial Sequence: Synthetic oligonucleotide

SEQ ID NO: 225 - DNA, 77 bp, Artificial Sequence; identical to SEQ ID NO: 1
  Description of Artificial Sequence: Synthetic oligonucleotide

SEQ ID NO: 226 - DNA, 77 bp, Artificial Sequence; identical to SEQ ID NO: 1
  Description of Artificial Sequence: Synthetic oligonucleotide

SEQ ID NO: 227 - DNA, 77 bp, Artificial Sequence; identical to SEQ ID NO: 1
  Description of Artificial Sequence: Synthetic oligonucleotide

SEQ ID NO: 228 - DNA, 77 bp, Artificial Sequence; identical to SEQ ID NO: 1
  Description of Artificial Sequence: Synthetic oligonucleotide

SEQ ID NO: 229 - DNA, 77 bp, Artificial Sequence; identical to SEQ ID NO: 1
  Description of Artificial Sequence: Synthetic oligonucleotide

SEQ ID NO: 230 - DNA, 77 bp, Artificial Sequence; identical to SEQ ID NO: 1
  Description of Artificial Sequence: Synthetic oligonucleotide

SEQ ID NO: 231 - DNA, 77 bp, Artificial Sequence; identical to SEQ ID NO: 1
  Description of Artificial Sequence: Synthetic oligonucleotide

SEQ ID NO: 232 - DNA, 77 bp, Artificial Sequence; identical to SEQ ID NO: 1
  Description of Artificial Sequence: Synthetic oligonucleotide

SEQ ID NO: 233 - DNA, 77 bp, Artificial Sequence; identical to SEQ ID NO: 1
  Description of Artificial Sequence: Synthetic oligonucleotide

SEQ ID NO: 234 - DNA, 77 bp, Artificial Sequence; identical to SEQ ID NO: 1
  Description of Artificial Sequence: Synthetic oligonucleotide

SEQ ID NO: 235 - DNA, 77 bp, Artificial Sequence; identical to SEQ ID NO: 1
  Description of Artificial Sequence: Synthetic oligonucleotide

SEQ ID NO: 236 - DNA, 77 bp, Artificial Sequence; identical to SEQ ID NO: 1
  Description of Artificial Sequence: Synthetic oligonucleotide

SEQ ID NO: 237 - DNA, 77 bp, Artificial Sequence; identical to SEQ ID NO: 1
  Description of Artificial Sequence: Synthetic oligonucleotide

SEQ ID NO: 238 - DNA, 77 bp, Artificial Sequence; identical to SEQ ID NO: 1
  Description of Artificial Sequence: Synthetic oligonucleotide

SEQ ID NO: 239 - DNA, 77 bp, Artificial Sequence; identical to SEQ ID NO: 1
  Description of Artificial Sequence: Synthetic oligonucleotide

SEQ ID NO: 240 - DNA, 77 bp, Artificial Sequence; identical to SEQ ID NO: 1
  Description of Artificial Sequence: Synthetic oligonucleotide

SEQ ID NO: 241 - DNA, 77 bp, Artificial Sequence; identical to SEQ ID NO: 1
  Description of Artificial Sequence: Synthetic oligonucleotide

SEQ ID NO: 242 - DNA, 77 bp, Artificial Sequence; identical to SEQ ID NO: 1
  Description of Artificial Sequence: Synthetic oligonucleotide

SEQ ID NO: 243 - DNA, 77 bp, Artificial Sequence; identical to SEQ ID NO: 1
  Description of Artificial Sequence: Synthetic oligonucleotide

SEQ ID NO: 244 - DNA, 77 bp, Artificial Sequence; identical to SEQ ID NO: 1
  Description of Artificial Sequence: Synthetic oligonucleotide

SEQ ID NO: 245 - DNA, 77 bp, Artificial Sequence; identical to SEQ ID NO: 1
  Description of Artificial Sequence: Synthetic oligonucleotide

SEQ ID NO: 246 - DNA, 77 bp, Artificial Sequence; identical to SEQ ID NO: 1
  Description of Artificial Sequence: Synthetic oligonucleotide

SEQ ID NO: 247 - DNA, 77 bp, Artificial Sequence; identical to SEQ ID NO: 1
  Description of Artificial Sequence: Synthetic oligonucleotide

SEQ ID NO: 248 - DNA, 77 bp, Artificial Sequence; identical to SEQ ID NO: 1
  Description of Artificial Sequence: Synthetic oligonucleotide

SEQ ID NO: 249 - DNA, 77 bp, Artificial Sequence; identical to SEQ ID NO: 1
  Description of Artificial Sequence: Synthetic oligonucleotide

SEQ ID NO: 250 - DNA, 77 bp, Artificial Sequence; identical to SEQ ID NO: 1
  Description of Artificial Sequence: Synthetic oligonucleotide

SEQ ID NO: 251 - DNA, 77 bp, Artificial Sequence; identical to SEQ ID NO: 1
  Description of Artificial Sequence: Synthetic oligonucleotide

SEQ ID NO: 252 - DNA, 77 bp, Artificial Sequence; identical to SEQ ID NO: 1
  Description of Artificial Sequence: Synthetic oligonucleotide

SEQ ID NO: 253 - DNA, 77 bp, Artificial Sequence; identical to SEQ ID NO: 1
  Description of Artificial Sequence: Synthetic oligonucleotide

SEQ ID NO: 254 - DNA, 77 bp, Artificial Sequence; identical to SEQ ID NO: 1
  Description of Artificial Sequence: Synthetic oligonucleotide

SEQ ID NO: 255 - DNA, 77 bp, Artificial Sequence; identical to SEQ ID NO: 1
  Description of Artificial Sequence: Synthetic oligonucleotide

SEQ ID NO: 256 - DNA, 77 bp, Artificial Sequence; identical to SEQ ID NO: 1
  Description of Artificial Sequence: Synthetic oligonucleotide

SEQ ID NO: 257 - DNA, 77 bp, Artificial Sequence; identical to SEQ ID NO: 1
  Description of Artificial Sequence: Synthetic oligonucleotide

SEQ ID NO: 258 - DNA, 77 bp, Artificial Sequence; identical to SEQ ID NO: 1
  Description of Artificial Sequence: Synthetic oligonucleotide

SEQ ID NO: 259 - DNA, 77 bp, Artificial Sequence; identical to SEQ ID NO: 1
  Description of Artificial Sequence: Synthetic oligonucleotide

SEQ ID NO: 260 - DNA, 77 bp, Artificial Sequence; identical to SEQ ID NO: 1
  Description of Artificial Sequence: Synthetic oligonucleotide

SEQ ID NO: 261 - DNA, 77 bp, Artificial Sequence; identical to SEQ ID NO: 1
  Description of Artificial Sequence: Synthetic oligonucleotide

SEQ ID NO: 262 - DNA, 77 bp, Artificial Sequence; identical to SEQ ID NO: 1
  Description of Artificial Sequence: Synthetic oligonucleotide

SEQ ID NO: 263 - DNA, 77 bp, Artificial Sequence; identical to SEQ ID NO: 1
  Description of Artificial Sequence: Synthetic oligonucleotide

SEQ ID NO: 264 - DNA, 77 bp, Artificial Sequence; identical to SEQ ID NO: 1
  Description of Artificial Sequence: Synthetic oligonucleotide

SEQ ID NO: 265 - DNA, 77 bp, Artificial Sequence; identical to SEQ ID NO: 1
  Description of Artificial Sequence: Synthetic oligonucleotide

SEQ ID NO: 266 - DNA, 77 bp, Artificial Sequence; identical to SEQ ID NO: 1
  Description of Artificial Sequence: Synthetic oligonucleotide

SEQ ID NO: 267 - DNA, 77 bp, Artificial Sequence; identical to SEQ ID NO: 1
  Description of Artificial Sequence: Synthetic oligonucleotide

SEQ ID NO: 268 - DNA, 77 bp, Artificial Sequence; identical to SEQ ID NO: 1
  Description of Artificial Sequence: Synthetic oligonucleotide

SEQ ID NO: 269 - DNA, 77 bp, Artificial Sequence; identical to SEQ ID NO: 1
  Description of Artificial Sequence: Synthetic oligonucleotide

SEQ ID NO: 270 - DNA, 77 bp, Artificial Sequence; identical to SEQ ID NO: 1
  Description of Artificial Sequence: Synthetic oligonucleotide

SEQ ID NO: 271 - DNA, 77 bp, Artificial Sequence; identical to SEQ ID NO: 1
  Description of Artificial Sequence: Synthetic oligonucleotide

SEQ ID NO: 272 - DNA, 77 bp, Artificial Sequence; identical to SEQ ID NO: 1
  Description of Artificial Sequence: Synthetic oligonucleotide

SEQ ID NO: 273 - DNA, 77 bp, Artificial Sequence; identical to SEQ ID NO: 1
  Description of Artificial Sequence: Synthetic oligonucleotide

SEQ ID NO: 274 - DNA, 77 bp, Artificial Sequence; identical to SEQ ID NO: 1
  Description of Artificial Sequence: Synthetic oligonucleotide

SEQ ID NO: 275 - DNA, 77 bp, Artificial Sequence; identical to SEQ ID NO: 1
  Description of Artificial Sequence: Synthetic oligonucleotide

SEQ ID NO: 276 - DNA, 77 bp, Artificial Sequence; identical to SEQ ID NO: 1
  Description of Artificial Sequence: Synthetic oligonucleotide

SEQ ID NO: 277 - DNA, 77 bp, Artificial Sequence; identical to SEQ ID NO: 1
  Description of Artificial Sequence: Synthetic oligonucleotide

SEQ ID NO: 278 - DNA, 77 bp, Artificial Sequence; identical to SEQ ID NO: 1
  Description of Artificial Sequence: Synthetic oligonucleotide

SEQ ID NO: 279 - DNA, 77 bp, Artificial Sequence; identical to SEQ ID NO: 1
  Description of Artificial Sequence: Synthetic oligonucleotide

SEQ ID NO: 280 - DNA, 77 bp, Artificial Sequence; identical to SEQ ID NO: 1
  Description of Artificial Sequence: Synthetic oligonucleotide

SEQ ID NO: 281 - DNA, 77 bp, Artificial Sequence; identical to SEQ ID NO: 1
  Description of Artificial Sequence: Synthetic oligonucleotide

SEQ ID NO: 282 - DNA, 77 bp, Artificial Sequence; identical to SEQ ID NO: 1
  Description of Artificial Sequence: Synthetic oligonucleotide

SEQ ID NO: 283 - DNA, 77 bp, Artificial Sequence; identical to SEQ ID NO: 1
  Description of Artificial Sequence: Synthetic oligonucleotide

SEQ ID NO: 284 - DNA, 77 bp, Artificial Sequence; identical to SEQ ID NO: 1
  Description of Artificial Sequence: Synthetic oligonucleotide

SEQ ID NO: 285 - DNA, 77 bp, Artificial Sequence; identical to SEQ ID NO: 1
  Description of Artificial Sequence: Synthetic oligonucleotide

SEQ ID NO: 286 - DNA, 77 bp, Artificial Sequence; identical to SEQ ID NO: 1
  Description of Artificial Sequence: Synthetic oligonucleotide

SEQ ID NO: 287 - DNA, 77 bp, Artificial Sequence; identical to SEQ ID NO: 1
  Description of Artificial Sequence: Synthetic oligonucleotide

SEQ ID NO: 288 - DNA, 77 bp, Artificial Sequence; identical to SEQ ID NO: 1
  Description of Artificial Sequence: Synthetic oligonucleotide

SEQ ID NO: 289 - DNA, 77 bp, Artificial Sequence; identical to SEQ ID NO: 1
  Description of Artificial Sequence: Synthetic oligonucleotide

SEQ ID NO: 290 - DNA, 77 bp, Artificial Sequence; identical to SEQ ID NO: 1
  Description of Artificial Sequence: Synthetic oligonucleotide

SEQ ID NO: 291 - DNA, 77 bp, Artificial Sequence; identical to SEQ ID NO: 1
  Description of Artificial Sequence: Synthetic oligonucleotide

SEQ ID NO: 292 - DNA, 77 bp, Artificial Sequence; identical to SEQ ID NO: 1
  Description of Artificial Sequence: Synthetic oligonucleotide

SEQ ID NO: 293 - DNA, 77 bp, Artificial Sequence; identical to SEQ ID NO: 1
  Description of Artificial Sequence: Synthetic oligonucleotide

SEQ ID NO: 294 - DNA, 77 bp, Artificial Sequence; identical to SEQ ID NO: 1
  Description of Artificial Sequence: Synthetic oligonucleotide

SEQ ID NO: 295 - DNA, 77 bp, Artificial Sequence; identical to SEQ ID NO: 1
  Description of Artificial Sequence: Synthetic oligonucleotide

SEQ ID NO: 296 - DNA, 77 bp, Artificial Sequence; identical to SEQ ID NO: 1
  Description of Artificial Sequence: Synthetic oligonucleotide

SEQ ID NO: 297 - DNA, 77 bp, Artificial Sequence; identical to SEQ ID NO: 1
  Description of Artificial Sequence: Synthetic oligonucleotide

SEQ ID NO: 298 - DNA, 77 bp, Artificial Sequence; identical to SEQ ID NO: 1
  Description of Artificial Sequence: Synthetic oligonucleotide

SEQ ID NO: 299 - DNA, 77 bp, Artificial Sequence; identical to SEQ ID NO: 1
  Description of Artificial Sequence: Synthetic oligonucleotide

SEQ ID NO: 300 - DNA, 77 bp, Artificial Sequence; identical to SEQ ID NO: 1
  Description of Artificial Sequence: Synthetic oligonucleotide

SEQ ID NO: 301 - DNA, 77 bp, Artificial Sequence; identical to SEQ ID NO: 1
  Description of Artificial Sequence: Synthetic oligonucleotide

SEQ ID NO: 302 - DNA, 77 bp, Artificial Sequence; identical to SEQ ID NO: 1
  Description of Artificial Sequence: Synthetic oligonucleotide

SEQ ID NO: 303 - DNA, 77 bp, Artificial Sequence; identical to SEQ ID NO: 1
  Description of Artificial Sequence: Synthetic oligonucleotide

SEQ ID NO: 304 - DNA, 77 bp, Artificial Sequence; identical to SEQ ID NO: 1
  Description of Artificial Sequence: Synthetic oligonucleotide

SEQ ID NO: 305 - DNA, 77 bp, Artificial Sequence; identical to SEQ ID NO: 1
  Description of Artificial Sequence: Synthetic oligonucleotide

SEQ ID NO: 306 - DNA, 77 bp, Artificial Sequence; identical to SEQ ID NO: 1
  Description of Artificial Sequence: Synthetic oligonucleotide

SEQ ID NO: 307 - DNA, 77 bp, Artificial Sequence; identical to SEQ ID NO: 1
  Description of Artificial Sequence: Synthetic oligonucleotide

SEQ ID NO: 308 - DNA, 77 bp, Artificial Sequence; identical to SEQ ID NO: 1
  Description of Artificial Sequence: Synthetic oligonucleotide

SEQ ID NO: 309 - DNA, 77 bp, Artificial Sequence; identical to SEQ ID NO: 1
  Description of Artificial Sequence: Synthetic oligonucleotide

SEQ ID NO: 310 - DNA, 77 bp, Artificial Sequence; identical to SEQ ID NO: 1
  Description of Artificial Sequence: Synthetic oligonucleotide

SEQ ID NO: 311 - DNA, 77 bp, Artificial Sequence; identical to SEQ ID NO: 1
  Description of Artificial Sequence: Synthetic oligonucleotide

SEQ ID NO: 312 - DNA, 77 bp, Artificial Sequence; identical to SEQ ID NO: 1
  Description of Artificial Sequence: Synthetic oligonucleotide

SEQ ID NO: 313 - DNA, 77 bp, Artificial Sequence; identical to SEQ ID NO: 1
  Description of Artificial Sequence: Synthetic oligonucleotide

SEQ ID NO: 314 - DNA, 77 bp, Artificial Sequence; identical to SEQ ID NO: 1
  Description of Artificial Sequence: Synthetic oligonucleotide

SEQ ID NO: 315 - DNA, 77 bp, Artificial Sequence; identical to SEQ ID NO: 1
  Description of Artificial Sequence: Synthetic oligonucleotide

SEQ ID NO: 316 - DNA, 77 bp, Artificial Sequence; identical to SEQ ID NO: 1
  Description of Artificial Sequence: Synthetic oligonucleotide

SEQ ID NO: 317 - DNA, 77 bp, Artificial Sequence; identical to SEQ ID NO: 1
  Description of Artificial Sequence: Synthetic oligonucleotide

SEQ ID NO: 318 - DNA, 77 bp, Artificial Sequence; identical to SEQ ID NO: 1
  Description of Artificial Sequence: Synthetic oligonucleotide

SEQ ID NO: 319 - DNA, 77 bp, Artificial Sequence; identical to SEQ ID NO: 1
  Description of Artificial Sequence: Synthetic oligonucleotide

SEQ ID NO: 320 - DNA, 77 bp, Artificial Sequence; identical to SEQ ID NO: 1
  Description of Artificial Sequence: Synthetic oligonucleotide

SEQ ID NO: 321 - DNA, 77 bp, Artificial Sequence; identical to SEQ ID NO: 1
  Description of Artificial Sequence: Synthetic oligonucleotide

SEQ ID NO: 322 - DNA, 77 bp, Artificial Sequence; identical to SEQ ID NO: 1
  Description of Artificial Sequence: Synthetic oligonucleotide

SEQ ID NO: 323 - DNA, 77 bp, Artificial Sequence; identical to SEQ ID NO: 1
  Description of Artificial Sequence: Synthetic oligonucleotide

SEQ ID NO: 324 - DNA, 77 bp, Artificial Sequence; identical to SEQ ID NO: 1
  Description of Artificial Sequence: Synthetic oligonucleotide

SEQ ID NO: 325 - DNA, 77 bp, Artificial Sequence; identical to SEQ ID NO: 1
  Description of Artificial Sequence: Synthetic oligonucleotide

SEQ ID NO: 326 - DNA, 77 bp, Artificial Sequence; identical to SEQ ID NO: 1
  Description of Artificial Sequence: Synthetic oligonucleotide

SEQ ID NO: 327 - DNA, 77 bp, Artificial Sequence; identical to SEQ ID NO: 1
  Description of Artificial Sequence: Synthetic oligonucleotide

SEQ ID NO: 328 - DNA, 77 bp, Artificial Sequence; identical to SEQ ID NO: 1
  Description of Artificial Sequence: Synthetic oligonucleotide

SEQ ID NO: 329 - DNA, 77 bp, Artificial Sequence; identical to SEQ ID NO: 1
  Description of Artificial Sequence: Synthetic oligonucleotide

SEQ ID NO: 330 - DNA, 77 bp, Artificial Sequence; identical to SEQ ID NO: 1
  Description of Artificial Sequence: Synthetic oligonucleotide

SEQ ID NO: 331 - DNA, 77 bp, Artificial Sequence; identical to SEQ ID NO: 1
  Description of Artificial Sequence: Synthetic oligonucleotide

SEQ ID NO: 332 - DNA, 77 bp, Artificial Sequence; identical to SEQ ID NO: 1
  Description of Artificial Sequence: Synthetic oligonucleotide

SEQ ID NO: 333 - DNA, 77 bp, Artificial Sequence; identical to SEQ ID NO: 1
  Description of Artificial Sequence: Synthetic oligonucleotide

SEQ ID NO: 334 - DNA, 77 bp, Artificial Sequence; identical to SEQ ID NO: 1
  Description of Artificial Sequence: Synthetic oligonucleotide

SEQ ID NO: 335 - DNA, 77 bp, Artificial Sequence; identical to SEQ ID NO: 1
  Description of Artificial Sequence: Synthetic oligonucleotide

SEQ ID NO: 336 - DNA, 77 bp, Artificial Sequence; identical to SEQ ID NO: 1
  Description of Artificial Sequence: Synthetic oligonucleotide

SEQ ID NO: 337 - DNA, 77 bp, Artificial Sequence; identical to SEQ ID NO: 1
  Description of Artificial Sequence: Synthetic oligonucleotide

SEQ ID NO: 338 - DNA, 77 bp, Artificial Sequence; identical to SEQ ID NO: 1
  Description of Artificial Sequence: Synthetic oligonucleotide

SEQ ID NO: 339 - DNA, 77 bp, Artificial Sequence; identical to SEQ ID NO: 1
  Description of Artificial Sequence: Synthetic oligonucleotide

SEQ ID NO: 340 - DNA, 77 bp, Artificial Sequence; identical to SEQ ID NO: 1
  Description of Artificial Sequence: Synthetic oligonucleotide

SEQ ID NO: 341 - DNA, 77 bp, Artificial Sequence; identical to SEQ ID NO: 1
  Description of Artificial Sequence: Synthetic oligonucleotide

SEQ ID NO: 342 - DNA, 77 bp, Artificial Sequence; identical to SEQ ID NO: 1
  Description of Artificial Sequence: Synthetic oligonucleotide

SEQ ID NO: 343 - DNA, 77 bp, Artificial Sequence; identical to SEQ ID NO: 1
  Description of Artificial Sequence: Synthetic oligonucleotide

SEQ ID NO: 344 - DNA, 77 bp, Artificial Sequence; identical to SEQ ID NO: 1
  Description of Artificial Sequence: Synthetic oligonucleotide

SEQ ID NO: 345 - DNA, 77 bp, Artificial Sequence; identical to SEQ ID NO: 1
  Description of Artificial Sequence: Synthetic oligonucleotide

SEQ ID NO: 346 - DNA, 77 bp, Artificial Sequence; identical to SEQ ID NO: 1
  Description of Artificial Sequence: Synthetic oligonucleotide

SEQ ID NO: 347 - DNA, 77 bp, Artificial Sequence; identical to SEQ ID NO: 1
  Description of Artificial Sequence: Synthetic oligonucleotide

SEQ ID NO: 348 - DNA, 77 bp, Artificial Sequence; identical to SEQ ID NO: 1
  Description of Artificial Sequence: Synthetic oligonucleotide

SEQ ID NO: 349 - DNA, 77 bp, Artificial Sequence; identical to SEQ ID NO: 1
  Description of Artificial Sequence: Synthetic oligonucleotide

SEQ ID NO: 350 - DNA, 77 bp, Artificial Sequence; identical to SEQ ID NO: 1
  Description of Artificial Sequence: Synthetic oligonucleotide

SEQ ID NO: 351 - DNA, 77 bp, Artificial Sequence; identical to SEQ ID NO: 1
  Description of Artificial Sequence: Synthetic oligonucleotide

SEQ ID NO: 352 - DNA, 77 bp, Artificial Sequence; identical to SEQ ID NO: 1
  Description of Artificial Sequence: Synthetic oligonucleotide

SEQ ID NO: 353 - DNA, 77 bp, Artificial Sequence; identical to SEQ ID NO: 1
  Description of Artificial Sequence: Synthetic oligonucleotide

SEQ ID NO: 354 - DNA, 77 bp, Artificial Sequence; identical to SEQ ID NO: 1
  Description of Artificial Sequence: Synthetic oligonucleotide

SEQ ID NO: 355 - DNA, 77 bp, Artificial Sequence; identical to SEQ ID NO: 1
  Description of Artificial Sequence: Synthetic oligonucleotide

SEQ ID NO: 356 - DNA, 77 bp, Artificial Sequence; identical to SEQ ID NO: 1
  Description of Artificial Sequence: Synthetic oligonucleotide

SEQ ID NO: 357 - DNA, 77 bp, Artificial Sequence; identical to SEQ ID NO: 1
  Description of Artificial Sequence: Synthetic oligonucleotide

SEQ ID NO: 358 - DNA, 77 bp, Artificial Sequence; identical to SEQ ID NO: 1
  Description of Artificial Sequence: Synthetic oligonucleotide

SEQ ID NO: 359 - DNA, 77 bp, Artificial Sequence; identical to SEQ ID NO: 1
  Description of Artificial Sequence: Synthetic oligonucleotide

SEQ ID NO: 360 - DNA, 77 bp, Artificial Sequence; identical to SEQ ID NO: 1
  Description of Artificial Sequence: Synthetic oligonucleotide

SEQ ID NO: 361 - DNA, 77 bp, Artificial Sequence; identical to SEQ ID NO: 1
  Description of Artificial Sequence: Synthetic oligonucleotide

SEQ ID NO: 362 - DNA, 77 bp, Artificial Sequence; identical to SEQ ID NO: 1
  Description of Artificial Sequence: Synthetic oligonucleotide

SEQ ID NO: 363 - DNA, 77 bp, Artificial Sequence; identical to SEQ ID NO: 1
  Description of Artificial Sequence: Synthetic oligonucleotide

SEQ ID NO: 364 - DNA, 77 bp, Artificial Sequence; identical to SEQ ID NO: 1
  Description of Artificial Sequence: Synthetic oligonucleotide

SEQ ID NO: 365 - DNA, 77 bp, Artificial Sequence; identical to SEQ ID NO: 1
  Description of Artificial Sequence: Synthetic oligonucleotide

SEQ ID NO: 366 - DNA, 77 bp, Artificial Sequence; identical to SEQ ID NO: 1
  Description of Artificial Sequence: Synthetic oligonucleotide

SEQ ID NO: 367 - DNA, 77 bp, Artificial Sequence; identical to SEQ ID NO: 1
  Description of Artificial Sequence: Synthetic oligonucleotide

SEQ ID NO: 368 - DNA, 77 bp, Artificial Sequence; identical to SEQ ID NO: 1
  Description of Artificial Sequence: Synthetic oligonucleotide

SEQ ID NO: 369 - DNA, 77 bp, Artificial Sequence; identical to SEQ ID NO: 1
  Description of Artificial Sequence: Synthetic oligonucleotide

SEQ ID NO: 370 - DNA, 77 bp, Artificial Sequence; identical to SEQ ID NO: 1
  Description of Artificial Sequence: Synthetic oligonucleotide

SEQ ID NO: 371 - DNA, 77 bp, Artificial Sequence; identical to SEQ ID NO: 1
  Description of Artificial Sequence: Synthetic oligonucleotide

SEQ ID NO: 372 - DNA, 77 bp, Artificial Sequence; identical to SEQ ID NO: 1
  Description of Artificial Sequence: Synthetic oligonucleotide

SEQ ID NO: 373 - DNA, 77 bp, Artificial Sequence; identical to SEQ ID NO: 1
  Description of Artificial Sequence: Synthetic oligonucleotide

SEQ ID NO: 374 - DNA, 77 bp, Artificial Sequence; identical to SEQ ID NO: 1
  Description of Artificial Sequence: Synthetic oligonucleotide

SEQ ID NO: 375 - DNA, 77 bp, Artificial Sequence; identical to SEQ ID NO: 1
  Description of Artificial Sequence: Synthetic oligonucleotide

SEQ ID NO: 376 - DNA, 77 bp, Artificial Sequence; identical to SEQ ID NO: 1
  Description of Artificial Sequence: Synthetic oligonucleotide

SEQ ID NO: 377 - DNA, 77 bp, Artificial Sequence; identical to SEQ ID NO: 1
  Description of Artificial Sequence: Synthetic oligonucleotide

SEQ ID NO: 378 - DNA, 77 bp, Artificial Sequence; identical to SEQ ID NO: 1
  Description of Artificial Sequence: Synthetic oligonucleotide

SEQ ID NO: 379 - DNA, 77 bp, Artificial Sequence; identical to SEQ ID NO: 1
  Description of Artificial Sequence: Synthetic oligonucleotide

SEQ ID NO: 380 - DNA, 77 bp, Artificial Sequence; identical to SEQ ID NO: 1
  Description of Artificial Sequence: Synthetic oligonucleotide

SEQ ID NO: 381 - DNA, 77 bp, Artificial Sequence; identical to SEQ ID NO: 1
  Description of Artificial Sequence: Synthetic oligonucleotide

SEQ ID NO: 382 - DNA, 77 bp, Artificial Sequence; identical to SEQ ID NO: 1
  Description of Artificial Sequence: Synthetic oligonucleotide

SEQ ID NO: 383 - DNA, 77 bp, Artificial Sequence; identical to SEQ ID NO: 1
  Description of Artificial Sequence: Synthetic oligonucleotide

SEQ ID NO: 384 - DNA, 77 bp, Artificial Sequence; identical to SEQ ID NO: 1
  Description of Artificial Sequence: Synthetic oligonucleotide

SEQ ID NO: 385 - DNA, 84 bp, Artificial Sequence
  Description of Artificial Sequence: Synthetic oligonucleotide
cctacgggaggcatcaggcagatctcgtcccttgtctccacgagactgattagtcagtcagccggattagataccctagtagtc

SEQ ID NO: 386 - DNA, 84 bp, Artificial Sequence
  Description of Artificial Sequence: Synthetic oligonucleotide
cctacgggaggcatcaggcagatctcggctgtacggattatcaccaggtgtagtcagtcagccggattagataccctagtagtc

SEQ ID NO: 387 - DNA, 84 bp, Artificial Sequence
  Description of Artificial Sequence: Synthetic oligonucleotide
cctacgggaggcatcaggcagatctcgtggtcaacgatacatcgcgttgacagtcagtcagccggattagataccctagtagtc

SEQ ID NO: 388 - DNA, 84 bp, Artificial Sequence
  Description of Artificial Sequence: Synthetic oligonucleotide
cctacgggaggcatcaggcagatctcgatcgcacagtaagcacatagtcgtagtcagtcagccggattagataccctagtagtc

SEQ ID NO: 389 - DNA, 84 bp, Artificial Sequence
  Description of Artificial Sequence: Synthetic oligonucleotide
cctacgggaggcatcaggcagatctcggtcgtgtagcctggcaaatacactagtcagtcagccggattagataccctagtagtc

SEQ ID NO: 390 - DNA, 84 bp, Artificial Sequence
  Description of Artificial Sequence: Synthetic oligonucleotide
cctacgggaggcatcaggcagatctcgagcggaggttaggtcatgctccagagtcagtcagccggattagataccctagtagtc

SEQ ID NO: 391 - DNA, 84 bp, Artificial Sequence
  Description of Artificial Sequence: Synthetic oligonucleotide
cctacgggaggcatcaggcagatctcgatcctttggttccctagtaagctgagtcagtcagccggattagataccctagtagtc

SEQ ID NO: 392 - DNA, 84 bp, Artificial Sequence
  Description of Artificial Sequence: Synthetic oligonucleotide
cctacgggaggcatcaggcagatctcgtacagcgcatacttaccgacgagtagtcagtcagccggattagataccctagtagtc

SEQ ID NO: 393 - DNA, 84 bp, Artificial Sequence
  Description of Artificial Sequence: Synthetic oligonucleotide
cctacgggaggcatcaggcagatctcgaccggtatgtacgcttagatgtagagtcagtcagccggattagataccctagtagtc

SEQ ID NO: 394 - DNA, 84 bp, Artificial Sequence
  Description of Artificial Sequence: Synthetic oligonucleotide
cctacgggaggcatcaggcagatctcgaattgtgtcggaaagacgtagcggagtcagtcagccggattagataccctagtagtc

SEQ ID NO: 395 - DNA, 84 bp, Artificial Sequence
  Description of Artificial Sequence: Synthetic oligonucleotide
cctacgggaggcatcaggcagatctcgtgcatacactggttaccttacaccagtcagtcagccggattagataccctagtagtc

SEQ ID NO: 396 - DNA, 84 bp, Artificial Sequence
  Description of Artificial Sequence: Synthetic oligonucleotide
cctacgggaggcatcaggcagatctcgagtcgaacgaggtgactaatggccagtcagtcagccggattagataccctagtagtc

SEQ ID NO: 397 - DNA, 84 bp, Artificial Sequence
  Description of Artificial Sequence: Synthetic oligonucleotide
cctacgggaggcatcaggcagatctcgaccagtgactcactctctcacttgagtcagtcagccggattagataccctagtagtc

SEQ ID NO: 398 - DNA, 84 bp, Artificial Sequence
  Description of Artificial Sequence: Synthetic oligonucleotide
cctacgggaggcatcaggcagatctcggaataccaagtcattgcaagcaacagtcagtcagccggattagataccctagtagtc

SEQ ID NO: 399 - DNA, 84 bp, Artificial Sequence
  Description of Artificial Sequence: Synthetic oligonucleotide
cctacgggaggcatcaggcagatctcggtagatcgtgtacacgtgacatgtagtcagtcagccggattagataccctagtagtc

SEQ ID NO: 400 - DNA, 84 bp, Artificial Sequence
  Description of Artificial Sequence: Synthetic oligonucleotide
cctacgggaggcatcaggcagatctcgtaacgtgtgtgccacagttgaagtagtcagtcagccggattagataccctagtagtc

SEQ ID NO: 401 - DNA, 84 bp, Artificial Sequence
  Description of Artificial Sequence: Synthetic oligonucleotide
cctacgggaggcatcaggcagatctcgcattatggcgtgctaggatcactgagtcagtcagccggattagataccctagtagtc

SEQ ID NO: 402 - DNA, 84 bp, Artificial Sequence
  Description of Artificial Sequence: Synthetic oligonucleotide
cctacgggaggcatcaggcagatctcgccaatacgcctggatgacccaaatagtcagtcagccggattagataccctagtagtc

SEQ ID NO: 403 - DNA, 84 bp, Artificial Sequence
  Description of Artificial Sequence: Synthetic oligonucleotide
cctacgggaggcatcaggcagatctcggatctgcgatccaccggagtaggaagtcagtcagccggattagataccctagtagtc

SEQ ID NO: 404 - DNA, 84 bp, Artificial Sequence
  Description of Artificial Sequence: Synthetic oligonucleotide
cctacgggaggcatcaggcagatctcgcagctcatcagctgaggactacctagtcagtcagccggattagataccctagtagtc

SEQ ID NO: 405 - DNA, 84 bp, Artificial Sequence
  Description of Artificial Sequence: Synthetic oligonucleotide
cctacgggaggcatcaggcagatctcgcaaacaacagctcaatcggcttgcagtcagtcagccggattagataccctagtagtc

SEQ ID NO: 406 - DNA, 84 bp, Artificial Sequence
  Description of Artificial Sequence: Synthetic oligonucleotide
cctacgggaggcatcaggcagatctcggcaacaccatccaacactcgatcgagtcagtcagccggattagataccctagtagtc

SEQ ID NO: 407 - DNA, 84 bp, Artificial Sequence
  Description of Artificial Sequence: Synthetic oligonucleotide
cctacgggaggcatcaggcagatctcggcgatatatcgctgaccggctgttagtcagtcagccggattagataccctagtagtc

SEQ ID NO: 408 - DNA, 84 bp, Artificial Sequence
  Description of Artificial Sequence: Synthetic oligonucleotide
cctacgggaggcatcaggcagatctcgcgagcaatcctaggaggagcaataagtcagtcagccggattagataccctagtagtc

SEQ ID NO: 409 - DNA, 84 bp, Artificial Sequence
  Description of Artificial Sequence: Synthetic oligonucleotide
cctacgggaggcatcaggcagatctcgagtcgtgcacatagcgacgaagacagtcagtcagccggattagataccctagtagtc

SEQ ID NO: 410 - DNA, 84 bp, Artificial Sequence
  Description of Artificial Sequence: Synthetic oligonucleotide
cctacgggaggcatcaggcagatctcggtatctgcgcgtcttccctaactcagtcagtcagccggattagataccctagtagtc

SEQ ID NO: 411 - DNA, 84 bp, Artificial Sequence
  Description of Artificial Sequence: Synthetic oligonucleotide
cctacgggaggcatcaggcagatctcgcgagggaaagtctggaagaacggcagtcagtcagccggattagataccctagtagtc

SEQ ID NO: 412 - DNA, 84 bp, Artificial Sequence
  Description of Artificial Sequence: Synthetic oligonucleotide
cctacgggaggcatcaggcagatctcgcaaattcgggatgctagacactacagtcagtcagccggattagataccctagtagtc

SEQ ID NO: 413 - DNA, 84 bp, Artificial Sequence
  Description of Artificial Sequence: Synthetic oligonucleotide
cctacgggaggcatcaggcagatctcgagattgaccaacttggattgaacgagtcagtcagccggattagataccctagtagtc

SEQ ID NO: 414 - DNA, 84 bp, Artificial Sequence
  Description of Artificial Sequence: Synthetic oligonucleotide
cctacgggaggcatcaggcagatctcgagttacgagctagatataccagtgagtcagtcagccggattagataccctagtagtc

SEQ ID NO: 415 - DNA, 84 bp, Artificial Sequence
  Description of Artificial Sequence: Synthetic oligonucleotide
cctacgggaggcatcaggcagatctcggcatatgcactgaacaaactgccaagtcagtcagccggattagataccctagtagtc

SEQ ID NO: 416 - DNA, 84 bp, Artificial Sequence
  Description of Artificial Sequence: Synthetic oligonucleotide
cctacgggaggcatcaggcagatctcgcaactcccgtgagtagacatgtgtagtcagtcagccggattagataccctagtagtc

SEQ ID NO: 417 - DNA, 84 bp, Artificial Sequence
  Description of Artificial Sequence: Synthetic oligonucleotide
cctacgggaggcatcaggcagatctcgttgcgttagcagtacagttacgcgagtcagtcagccggattagataccctagtagtc

SEQ ID NO: 418 - DNA, 84 bp, Artificial Sequence
  Description of Artificial Sequence: Synthetic oligonucleotide
cctacgggaggcatcaggcagatctcgtacgagccctaacaagccctagtaagtcagtcagccggattagataccctagtagtc

SEQ ID NO: 419 - DNA, 84 bp, Artificial Sequence
  Description of Artificial Sequence: Synthetic oligonucleotide
cctacgggaggcatcaggcagatctcgcactacgctagatagtgtcggatcagtcagtcagccggattagataccctagtagtc

SEQ ID NO: 420 - DNA, 84 bp, Artificial Sequence
  Description of Artificial Sequence: Synthetic oligonucleotide
cctacgggaggcatcaggcagatctcgtgcagtcctcgactgagctctgcaagtcagtcagccggattagataccctagtagtc

SEQ ID NO: 421 - DNA, 84 bp, Artificial Sequence
  Description of Artificial Sequence: Synthetic oligonucleotide
cctacgggaggcatcaggcagatctcgaccatagctccgcttcgactttccagtcagtcagccggattagataccctagtagtc

SEQ ID NO: 422 - DNA, 84 bp, Artificial Sequence
  Description of Artificial Sequence: Synthetic oligonucleotide
cctacgggaggcatcaggcagatctcgtcgacatctcttgtcataagaaccagtcagtcagccggattagataccctagtagtc

SEQ ID NO: 423 - DNA, 84 bp, Artificial Sequence
  Description of Artificial Sequence: Synthetic oligonucleotide
cctacgggaggcatcaggcagatctcggaacactttggagtccgcaagttaagtcagtcagccggattagataccctagtagtc

SEQ ID NO: 424 - DNA, 84 bp, Artificial Sequence
  Description of Artificial Sequence: Synthetic oligonucleotide
cctacgggaggcatcaggcagatctcggagccatctgtacgtagagctctcagtcagtcagccggattagataccctagtagtc

SEQ ID NO: 425 - DNA, 84 bp, Artificial Sequence
  Description of Artificial Sequence: Synthetic oligonucleotide
cctacgggaggcatcaggcagatctcgttgggtacacgtcctctgagagctagtcagtcagccggattagataccctagtagtc

SEQ ID NO: 426 - DNA, 84 bp, Artificial Sequence
  Description of Artificial Sequence: Synthetic oligonucleotide
cctacgggaggcatcaggcagatctcgaaggcgctccttcctcgatgcagtagtcagtcagccggattagataccctagtagtc

SEQ ID NO: 427 - DNA, 84 bp, Artificial Sequence
  Description of Artificial Sequence: Synthetic oligonucleotide
cctacgggaggcatcaggcagatctcgtaatacggatcggcggactattcaagtcagtcagccggattagataccctagtagtc

SEQ ID NO: 428 - DNA, 84 bp, Artificial Sequence
  Description of Artificial Sequence: Synthetic oligonucleotide
cctacgggaggcatcaggcagatctcgtcggaattagaccgtgcacaattgagtcagtcagccggattagataccctagtagtc

SEQ ID NO: 429 - DNA, 84 bp, Artificial Sequence
  Description of Artificial Sequence: Synthetic oligonucleotide
cctacgggaggcatcaggcagatctcgtgtgaattcggacggcctaagttcagtcagtcagccggattagataccctagtagtc

SEQ ID NO: 430 - DNA, 84 bp, Artificial Sequence
  Description of Artificial Sequence: Synthetic oligonucleotide
cctacgggaggcatcaggcagatctcgcattcgtggcgtagcgctcacatcagtcagtcagccggattagataccctagtagtc

SEQ ID NO: 431 - DNA, 84 bp, Artificial Sequence
  Description of Artificial Sequence: Synthetic oligonucleotide
cctacgggaggcatcaggcagatctcgtactacgtggcctggttatggcacagtcagtcagccggattagataccctagtagtc

SEQ ID NO: 432 - DNA, 84 bp, Artificial Sequence
  Description of Artificial Sequence: Synthetic oligonucleotide
cctacgggaggcatcaggcagatctcgggccagttcctacgaggttctgatagtcagtcagccggattagataccctagtagtc

SEQ ID NO: 433 - DNA, 84 bp, Artificial Sequence
  Description of Artificial Sequence: Synthetic oligonucleotide
cctacgggaggcatcaggcagatctcggatgttcgctagaactcctgtggaagtcagtcagccggattagataccctagtagtc

SEQ ID NO: 434 - DNA, 84 bp, Artificial Sequence
  Description of Artificial Sequence: Synthetic oligonucleotide
cctacgggaggcatcaggcagatctcgctatctcctgtctaatggtcgtagagtcagtcagccggattagataccctagtagtc

SEQ ID NO: 435 - DNA, 84 bp, Artificial Sequence
  Description of Artificial Sequence: Synthetic oligonucleotide
cctacgggaggcatcaggcagatctcgactcacaggaatttgcaccgtcgaagtcagtcagccggattagataccctagtagtc

SEQ ID NO: 436 - DNA, 84 bp, Artificial Sequence
  Description of Artificial Sequence: Synthetic oligonucleotide
cctacgggaggcatcaggcagatctcgatgatgagcctctgctacagacgtagtcagtcagccggattagataccctagtagtc

SEQ ID NO: 437 - DNA, 84 bp, Artificial Sequence
  Description of Artificial Sequence: Synthetic oligonucleotide
cctacgggaggcatcaggcagatctcggtcgacagaggaatggcctgactaagtcagtcagccggattagataccctagtagtc

SEQ ID NO: 438 - DNA, 84 bp, Artificial Sequence
  Description of Artificial Sequence: Synthetic oligonucleotide
cctacgggaggcatcaggcagatctcgtgtcgcaaatagacgcacatacaaagtcagtcagccggattagataccctagtagtc

SEQ ID NO: 439 - DNA, 84 bp, Artificial Sequence
  Description of Artificial Sequence: Synthetic oligonucleotide
cctacgggaggcatcaggcagatctcgcatccctctacttgagtggtctgtagtcagtcagccggattagataccctagtagtc

SEQ ID NO: 440 - DNA, 84 bp, Artificial Sequence
  Description of Artificial Sequence: Synthetic oligonucleotide
cctacgggaggcatcaggcagatctcgtataccgctgcggatagcactcgtagtcagtcagccggattagataccctagtagtc

SEQ ID NO: 441 - DNA, 84 bp, Artificial Sequence
  Description of Artificial Sequence: Synthetic oligonucleotide
cctacgggaggcatcaggcagatctcgagttgaggcatttagcgcgaacttagtcagtcagccggattagataccctagtagtc

SEQ ID NO: 442 - DNA, 84 bp, Artificial Sequence
  Description of Artificial Sequence: Synthetic oligonucleotide
cctacgggaggcatcaggcagatctcgacaatagacacccatacacgcaccagtcagtcagccggattagataccctagtagtc

SEQ ID NO: 443 - DNA, 84 bp, Artificial Sequence
  Description of Artificial Sequence: Synthetic oligonucleotide
cctacgggaggcatcaggcagatctcgcggtcaattgacacctcagtcaagagtcagtcagccggattagataccctagtagtc

SEQ ID NO: 444 - DNA, 84 bp, Artificial Sequence
  Description of Artificial Sequence: Synthetic oligonucleotide
cctacgggaggcatcaggcagatctcggtggagtctcattcgaccaaacacagtcagtcagccggattagataccctagtagtc

SEQ ID NO: 445 - DNA, 84 bp, Artificial Sequence
  Description of Artificial Sequence: Synthetic oligonucleotide
cctacgggaggcatcaggcagatctcggctcgaagattcccacccagtaacagtcagtcagccggattagataccctagtagtc

SEQ ID NO: 446 - DNA, 84 bp, Artificial Sequence
  Description of Artificial Sequence: Synthetic oligonucleotide
cctacgggaggcatcaggcagatctcgaggcttacgtgtatatcgcgatgaagtcagtcagccggattagataccctagtagtc

SEQ ID NO: 447 - DNA, 84 bp, Artificial Sequence
  Description of Artificial Sequence: Synthetic oligonucleotide
cctacgggaggcatcaggcagatctcgtctctaccactccgccggtaatctagtcagtcagccggattagataccctagtagtc

SEQ ID NO: 448 - DNA, 84 bp, Artificial Sequence
  Description of Artificial Sequence: Synthetic oligonucleotide
cctacgggaggcatcaggcagatctcgacttccaacttcccgatgccttgaagtcagtcagccggattagataccctagtagtc

SEQ ID NO: 449 - DNA, 84 bp, Artificial Sequence
  Description of Artificial Sequence: Synthetic oligonucleotide
cctacgggaggcatcaggcagatctcgctcacctaggaaagcaggcacgaaagtcagtcagccggattagataccctagtagtc

SEQ ID NO: 450 - DNA, 84 bp, Artificial Sequence
  Description of Artificial Sequence: Synthetic oligonucleotide
cctacgggaggcatcaggcagatctcggtgttgtcgtgctacgcagcactaagtcagtcagccggattagataccctagtagtc

SEQ ID NO: 451 - DNA, 84 bp, Artificial Sequence
  Description of Artificial Sequence: Synthetic oligonucleotide
cctacgggaggcatcaggcagatctcgccacagatcgatcgcttagtgctgagtcagtcagccggattagataccctagtagtc

SEQ ID NO: 452 - DNA, 84 bp, Artificial Sequence
  Description of Artificial Sequence: Synthetic oligonucleotide
cctacgggaggcatcaggcagatctcgtatcgacacaagcaaagtttgcgaagtcagtcagccggattagataccctagtagtc

SEQ ID NO: 453 - DNA, 84 bp, Artificial Sequence
  Description of Artificial Sequence: Synthetic oligonucleotide
cctacgggaggcatcaggcagatctcggattccggctcatcgagccgatctagtcagtcagccggattagataccctagtagtc

SEQ ID NO: 454 - DNA, 84 bp, Artificial Sequence
  Description of Artificial Sequence: Synthetic oligonucleotide
cctacgggaggcatcaggcagatctcgcgtaattgccgcctcatcatgttcagtcagtcagccggattagataccctagtagtc

SEQ ID NO: 455 - DNA, 84 bp, Artificial Sequence
  Description of Artificial Sequence: Synthetic oligonucleotide
cctacgggaggcatcaggcagatctcgggtgactagttcccagggacttctagtcagtcagccggattagataccctagtagtc

SEQ ID NO: 456 - DNA, 84 bp, Artificial Sequence
  Description of Artificial Sequence: Synthetic oligonucleotide
cctacgggaggcatcaggcagatctcgatgggttccgtcgcaatccttgcgagtcagtcagccggattagataccctagtagtc

SEQ ID NO: 457 - DNA, 84 bp, Artificial Sequence
  Description of Artificial Sequence: Synthetic oligonucleotide
cctacgggaggcatcaggcagatctcgtaggcatgcttgcctgcttccttcagtcagtcagccggattagataccctagtagtc

SEQ ID NO: 458 - DNA, 84 bp, Artificial Sequence
  Description of Artificial Sequence: Synthetic oligonucleotide
cctacgggaggcatcaggcagatctcgaactagttcaggcaaggcacaaggagtcagtcagccggattagataccctagtagtc

SEQ ID NO: 459 - DNA, 84 bp, Artificial Sequence
  Description of Artificial Sequence: Synthetic oligonucleotide
cctacgggaggcatcaggcagatctcgattctgccgaagggcctataagtcagtcagtcagccggattagataccctagtagtc

SEQ ID NO: 460 - DNA, 84 bp, Artificial Sequence
  Description of Artificial Sequence: Synthetic oligonucleotide
cctacgggaggcatcaggcagatctcgagcatgtcccgttccatttcatgcagtcagtcagccggattagataccctagtagtc

SEQ ID NO: 461 - DNA, 84 bp, Artificial Sequence
  Description of Artificial Sequence: Synthetic oligonucleotide
cctacgggaggcatcaggcagatctcggtacgatatgactcggcgatcatcagtcagtcagccggattagataccctagtagtc

SEQ ID NO: 462 - DNA, 84 bp, Artificial Sequence
  Description of Artificial Sequence: Synthetic oligonucleotide
cctacgggaggcatcaggcagatctcggtggtggtttccgtttcacgcgaaagtcagtcagccggattagataccctagtagtc

SEQ ID NO: 463 - DNA, 84 bp, Artificial Sequence
  Description of Artificial Sequence: Synthetic oligonucleotide
cctacgggaggcatcaggcagatctcgtagtatgcgcaaacaagaaccttgagtcagtcagccggattagataccctagtagtc

SEQ ID NO: 464 - DNA, 84 bp, Artificial Sequence
  Description of Artificial Sequence: Synthetic oligonucleotide
cctacgggaggcatcaggcagatctcgtgcgctgaatgttactctcttagcagtcagtcagccggattagataccctagtagtc

SEQ ID NO: 465 - DNA, 84 bp, Artificial Sequence
  Description of Artificial Sequence: Synthetic oligonucleotide
cctacgggaggcatcaggcagatctcgatggctgtcagtaactgttcgcgcagtcagtcagccggattagataccctagtagtc

SEQ ID NO: 466 - DNA, 84 bp, Artificial Sequence
  Description of Artificial Sequence: Synthetic oligonucleotide
cctacgggaggcatcaggcagatctcggttctcttctcgcgaagcatctacagtcagtcagccggattagataccctagtagtc

SEQ ID NO: 467 - DNA, 84 bp, Artificial Sequence
  Description of Artificial Sequence: Synthetic oligonucleotide
cctacgggaggcatcaggcagatctcgcgtaagatgcctgtttggccacacagtcagtcagccggattagataccctagtagtc

SEQ ID NO: 468 - DNA, 84 bp, Artificial Sequence
  Description of Artificial Sequence: Synthetic oligonucleotide
cctacgggaggcatcaggcagatctcggcgttctagctgtcaggttgcccaagtcagtcagccggattagataccctagtagtc

SEQ ID NO: 469 - DNA, 84 bp, Artificial Sequence
  Description of Artificial Sequence: Synthetic oligonucleotide
cctacgggaggcatcaggcagatctcggttgttctgggatcattccactcaagtcagtcagccggattagataccctagtagtc

SEQ ID NO: 470 - DNA, 84 bp, Artificial Sequence
  Description of Artificial Sequence: Synthetic oligonucleotide
cctacgggaggcatcaggcagatctcgggacttccagctgtcacatcacgaagtcagtcagccggattagataccctagtagtc

SEQ ID NO: 471 - DNA, 84 bp, Artificial Sequence
  Description of Artificial Sequence: Synthetic oligonucleotide
cctacgggaggcatcaggcagatctcgctcacaaccgtgcgacatttctctagtcagtcagccggattagataccctagtagtc

SEQ ID NO: 472 - DNA, 84 bp, Artificial Sequence
  Description of Artificial Sequence: Synthetic oligonucleotide
cctacgggaggcatcaggcagatctcgctgctattcctcggacgttaactaagtcagtcagccggattagataccctagtagtc

SEQ ID NO: 473 - DNA, 84 bp, Artificial Sequence
  Description of Artificial Sequence: Synthetic oligonucleotide
cctacgggaggcatcaggcagatctcgatgtcaccgctgtagcagttgcgtagtcagtcagccggattagataccctagtagtc

SEQ ID NO: 474 - DNA, 84 bp, Artificial Sequence
  Description of Artificial Sequence: Synthetic oligonucleotide
cctacgggaggcatcaggcagatctcgtgtaacgccgatcacgctattggaagtcagtcagccggattagataccctagtagtc

SEQ ID NO: 475 - DNA, 84 bp, Artificial Sequence
  Description of Artificial Sequence: Synthetic oligonucleotide
cctacgggaggcatcaggcagatctcgagcagaacatctaacttcacttccagtcagtcagccggattagataccctagtagtc

SEQ ID NO: 476 - DNA, 84 bp, Artificial Sequence
  Description of Artificial Sequence: Synthetic oligonucleotide
cctacgggaggcatcaggcagatctcgtggagtaggtggccagtggatataagtcagtcagccggattagataccctagtagtc

SEQ ID NO: 477 - DNA, 84 bp, Artificial Sequence
  Description of Artificial Sequence: Synthetic oligonucleotide
cctacgggaggcatcaggcagatctcgttggctctattctgtgtgtaacgcagtcagtcagccggattagataccctagtagtc

SEQ ID NO: 478 - DNA, 84 bp, Artificial Sequence
  Description of Artificial Sequence: Synthetic oligonucleotide
cctacgggaggcatcaggcagatctcggatcccacgtacccaatcgtgcaaagtcagtcagccggattagataccctagtagtc

SEQ ID NO: 479 - DNA, 84 bp, Artificial Sequence
  Description of Artificial Sequence: Synthetic oligonucleotide
cctacgggaggcatcaggcagatctcgtaccgcttcttcaggctagcagagagtcagtcagccggattagataccctagtagtc

SEQ ID NO: 480 - DNA, 84 bp, Artificial Sequence
  Description of Artificial Sequence: Synthetic oligonucleotide
cctacgggaggcatcaggcagatctcgtgtgcgataacagtcactccgaacagtcagtcagccggattagataccctagtagtc

SEQ ID NO: 481 - DNA, 84 bp, Artificial Sequence
  Description of Artificial Sequence: Synthetic oligonucleotide
cctacgggaggcatcaggcagatctcggattatcgacgacaccgaaatctgagtcagtcagccggattagataccctagtagtc

SEQ ID NO: 482 - DNA, 84 bp, Artificial Sequence
  Description of Artificial Sequence: Synthetic oligonucleotide
cctacgggaggcatcaggcagatctcggcctagcccaattgacgtagaactagtcagtcagccggattagataccctagtagtc

SEQ ID NO: 483 - DNA, 84 bp, Artificial Sequence
  Description of Artificial Sequence: Synthetic oligonucleotide
cctacgggaggcatcaggcagatctcggatgtatgtggtctatgccggctaagtcagtcagccggattagataccctagtagtc

SEQ ID NO: 484 - DNA, 84 bp, Artificial Sequence
  Description of Artificial Sequence: Synthetic oligonucleotide
cctacgggaggcatcaggcagatctcgactccttgtgttgtggtatgggagagtcagtcagccggattagataccctagtagtc

SEQ ID NO: 485 - DNA, 84 bp, Artificial Sequence
  Description of Artificial Sequence: Synthetic oligonucleotide
cctacgggaggcatcaggcagatctcggtcacggacatttgtaccaaccgaagtcagtcagccggattagataccctagtagtc

SEQ ID NO: 486 - DNA, 84 bp, Artificial Sequence
  Description of Artificial Sequence: Synthetic oligonucleotide
cctacgggaggcatcaggcagatctcggcgagcgaagtaagggtacagggtagtcagtcagccggattagataccctagtagtc

SEQ ID NO: 487 - DNA, 84 bp, Artificial Sequence
  Description of Artificial Sequence: Synthetic oligonucleotide
cctacgggaggcatcaggcagatctcgatctaccgaagcagagtgctaatcagtcagtcagccggattagataccctagtagtc

SEQ ID NO: 488 - DNA, 84 bp, Artificial Sequence
  Description of Artificial Sequence: Synthetic oligonucleotide
cctacgggaggcatcaggcagatctcgacttggtgtaagttggcgggttatagtcagtcagccggattagataccctagtagtc

SEQ ID NO: 489 - DNA, 84 bp, Artificial Sequence
  Description of Artificial Sequence: Synthetic oligonucleotide
cctacgggaggcatcaggcagatctcgtcttggaggtcacacgatggtcatagtcagtcagccggattagataccctagtagtc

SEQ ID NO: 490 - DNA, 84 bp, Artificial Sequence
  Description of Artificial Sequence: Synthetic oligonucleotide
cctacgggaggcatcaggcagatctcgtcacctccttgtgtcaccaatccgagtcagtcagccggattagataccctagtagtc

SEQ ID NO: 491 - DNA, 84 bp, Artificial Sequence
  Description of Artificial Sequence: Synthetic oligonucleotide
cctacgggaggcatcaggcagatctcggcacacctgatacactaacaaacgagtcagtcagccggattagataccctagtagtc

SEQ ID NO: 492 - DNA, 84 bp, Artificial Sequence
  Description of Artificial Sequence: Synthetic oligonucleotide
cctacgggaggcatcaggcagatctcggcgacaattacattccaggcagatagtcagtcagccggattagataccctagtagtc

SEQ ID NO: 493 - DNA, 84 bp, Artificial Sequence
  Description of Artificial Sequence: Synthetic oligonucleotide
cctacgggaggcatcaggcagatctcgtcatgctccatttatggtacccagagtcagtcagccggattagataccctagtagtc

SEQ ID NO: 494 - DNA, 84 bp, Artificial Sequence
  Description of Artificial Sequence: Synthetic oligonucleotide
cctacgggaggcatcaggcagatctcgagctgtcaagctcacgacttgacaagtcagtcagccggattagataccctagtagtc

SEQ ID NO: 495 - DNA, 84 bp, Artificial Sequence
  Description of Artificial Sequence: Synthetic oligonucleotide
cctacgggaggcatcaggcagatctcggagagcaacagacttggaggcttaagtcagtcagccggattagataccctagtagtc

SEQ ID NO: 496 - DNA, 84 bp, Artificial Sequence
  Description of Artificial Sequence: Synthetic oligonucleotide
cctacgggaggcatcaggcagatctcgtactcgggaactacgtggttccacagtcagtcagccggattagataccctagtagtc

SEQ ID NO: 497 - DNA, 84 bp, Artificial Sequence
  Description of Artificial Sequence: Synthetic oligonucleotide
cctacgggaggcatcaggcagatctcgcgtgcttaggctgacgctttgctgagtcagtcagccggattagataccctagtagtc

SEQ ID NO: 498 - DNA, 84 bp, Artificial Sequence
  Description of Artificial Sequence: Synthetic oligonucleotide
cctacgggaggcatcaggcagatctcgtaccgaaggtatacagggtttgtaagtcagtcagccggattagataccctagtagtc

SEQ ID NO: 499 - DNA, 84 bp, Artificial Sequence
  Description of Artificial Sequence: Synthetic oligonucleotide
cctacgggaggcatcaggcagatctcgcactcatcattcgcctatgagatcagtcagtcagccggattagataccctagtagtc

SEQ ID NO: 500 - DNA, 84 bp, Artificial Sequence
  Description of Artificial Sequence: Synthetic oligonucleotide
cctacgggaggcatcaggcagatctcggtatttcggacgcaaacctatggcagtcagtcagccggattagataccctagtagtc

SEQ ID NO: 501 - DNA, 84 bp, Artificial Sequence
  Description of Artificial Sequence: Synthetic oligonucleotide
cctacgggaggcatcaggcagatctcgtatctatcctgcatcgcttaaggcagtcagtcagccggattagataccctagtagtc

SEQ ID NO: 502 - DNA, 84 bp, Artificial Sequence
  Description of Artificial Sequence: Synthetic oligonucleotide
cctacgggaggcatcaggcagatctcgttgccaagagtcaccatccaacgaagtcagtcagccggattagataccctagtagtc

SEQ ID NO: 503 - DNA, 84 bp, Artificial Sequence
  Description of Artificial Sequence: Synthetic oligonucleotide
cctacgggaggcatcaggcagatctcgagtagcggaagagcaataggaggaagtcagtcagccggattagataccctagtagtc

SEQ ID NO: 504 - DNA, 84 bp, Artificial Sequence
  Description of Artificial Sequence: Synthetic oligonucleotide
cctacgggaggcatcaggcagatctcggcaattaggtacccgaacgtcactagtcagtcagccggattagataccctagtagtc

SEQ ID NO: 505 - DNA, 84 bp, Artificial Sequence
  Description of Artificial Sequence: Synthetic oligonucleotide
cctacgggaggcatcaggcagatctcgcataccgtgagtacaccaacaccaagtcagtcagccggattagataccctagtagtc

SEQ ID NO: 506 - DNA, 84 bp, Artificial Sequence
  Description of Artificial Sequence: Synthetic oligonucleotide
cctacgggaggcatcaggcagatctcgatgtgtgtagacccatcacataggagtcagtcagccggattagataccctagtagtc

SEQ ID NO: 507 - DNA, 84 bp, Artificial Sequence
  Description of Artificial Sequence: Synthetic oligonucleotide
cctacgggaggcatcaggcagatctcgcctgcgaagtatcgacacggagaaagtcagtcagccggattagataccctagtagtc

SEQ ID NO: 508 - DNA, 84 bp, Artificial Sequence
  Description of Artificial Sequence: Synthetic oligonucleotide
cctacgggaggcatcaggcagatctcgttctctcgacatgaacctatgacaagtcagtcagccggattagataccctagtagtc

SEQ ID NO: 509 - DNA, 84 bp, Artificial Sequence
  Description of Artificial Sequence: Synthetic oligonucleotide
cctacgggaggcatcaggcagatctcggctctccgtagaatgccggtaataagtcagtcagccggattagataccctagtagtc

SEQ ID NO: 510 - DNA, 84 bp, Artificial Sequence
  Description of Artificial Sequence: Synthetic oligonucleotide
cctacgggaggcatcaggcagatctcggttaagctgaccgaacagctctacagtcagtcagccggattagataccctagtagtc

SEQ ID NO: 511 - DNA, 84 bp, Artificial Sequence
  Description of Artificial Sequence: Synthetic oligonucleotide
cctacgggaggcatcaggcagatctcgatgccatgccgtgtgagtcataccagtcagtcagccggattagataccctagtagtc

SEQ ID NO: 512 - DNA, 84 bp, Artificial Sequence
  Description of Artificial Sequence: Synthetic oligonucleotide
cctacgggaggcatcaggcagatctcggacattgtcacgtggccgttactgagtcagtcagccggattagataccctagtagtc

SEQ ID NO: 513 - DNA, 84 bp, Artificial Sequence
  Description of Artificial Sequence: Synthetic oligonucleotide
cctacgggaggcatcaggcagatctcggccaacaaccattagagctgccatagtcagtcagccggattagataccctagtagtc

SEQ ID NO: 514 - DNA, 84 bp, Artificial Sequence
  Description of Artificial Sequence: Synthetic oligonucleotide
cctacgggaggcatcaggcagatctcgatcagtactaggatctagtggcaaagtcagtcagccggattagataccctagtagtc

SEQ ID NO: 515 - DNA, 84 bp, Artificial Sequence
  Description of Artificial Sequence: Synthetic oligonucleotide
cctacgggaggcatcaggcagatctcgtcctcgagcgatccttcaatgggaagtcagtcagccggattagataccctagtagtc

SEQ ID NO: 516 - DNA, 84 bp, Artificial Sequence
  Description of Artificial Sequence: Synthetic oligonucleotide
cctacgggaggcatcaggcagatctcgacccaagcgttattgacgacatcgagtcagtcagccggattagataccctagtagtc

SEQ ID NO: 517 - DNA, 84 bp, Artificial Sequence
  Description of Artificial Sequence: Synthetic oligonucleotide
cctacgggaggcatcaggcagatctcgtgcagcaagattacatactgagcaagtcagtcagccggattagataccctagtagtc

SEQ ID NO: 518 - DNA, 84 bp, Artificial Sequence
  Description of Artificial Sequence: Synthetic oligonucleotide
cctacgggaggcatcaggcagatctcgagcaacattgcaggctaaactatgagtcagtcagccggattagataccctagtagtc

SEQ ID NO: 519 - DNA, 84 bp, Artificial Sequence
  Description of Artificial Sequence: Synthetic oligonucleotide
cctacgggaggcatcaggcagatctcggatgtggtgttaaagagcagagccagtcagtcagccggattagataccctagtagtc

SEQ ID NO: 520 - DNA, 84 bp, Artificial Sequence
  Description of Artificial Sequence: Synthetic oligonucleotide
cctacgggaggcatcaggcagatctcgcagaaatgtgtcggagagatcacgagtcagtcagccggattagataccctagtagtc

SEQ ID NO: 521 - DNA, 84 bp, Artificial Sequence
  Description of Artificial Sequence: Synthetic oligonucleotide
cctacgggaggcatcaggcagatctcggtagaggtagagtcaacccgtgaaagtcagtcagccggattagataccctagtagtc

SEQ ID NO: 522 - DNA, 84 bp, Artificial Sequence
  Description of Artificial Sequence: Synthetic oligonucleotide
cctacgggaggcatcaggcagatctcgcgtgatccgctagtttgaaacacgagtcagtcagccggattagataccctagtagtc

SEQ ID NO: 523 - DNA, 84 bp, Artificial Sequence
  Description of Artificial Sequence: Synthetic oligonucleotide
cctacgggaggcatcaggcagatctcgggttatttggcgagagagacaggtagtcagtcagccggattagataccctagtagtc

SEQ ID NO: 524 - DNA, 84 bp, Artificial Sequence
  Description of Artificial Sequence: Synthetic oligonucleotide
cctacgggaggcatcaggcagatctcgggatcgtaatactcgccagtgcatagtcagtcagccggattagataccctagtagtc

SEQ ID NO: 525 - DNA, 84 bp, Artificial Sequence
  Description of Artificial Sequence: Synthetic oligonucleotide
cctacgggaggcatcaggcagatctcggcatagcatcaagctcaggactctagtcagtcagccggattagataccctagtagtc

SEQ ID NO: 526 - DNA, 84 bp, Artificial Sequence
  Description of Artificial Sequence: Synthetic oligonucleotide
cctacgggaggcatcaggcagatctcggtgttagatgtgcactttgggtgcagtcagtcagccggattagataccctagtagtc

SEQ ID NO: 527 - DNA, 84 bp, Artificial Sequence
  Description of Artificial Sequence: Synthetic oligonucleotide
cctacgggaggcatcaggcagatctcgttagagccatgctctagcctggcaagtcagtcagccggattagataccctagtagtc

SEQ ID NO: 528 - DNA, 84 bp, Artificial Sequence
  Description of Artificial Sequence: Synthetic oligonucleotide
cctacgggaggcatcaggcagatctcgtgaaccctatggaatgcaatgcgtagtcagtcagccggattagataccctagtagtc

SEQ ID NO: 529 - DNA, 84 bp, Artificial Sequence
  Description of Artificial Sequence: Synthetic oligonucleotide
cctacgggaggcatcaggcagatctcgagagtcttgccacgaatgagtcatagtcagtcagccggattagataccctagtagtc

SEQ ID NO: 530 - DNA, 84 bp, Artificial Sequence
  Description of Artificial Sequence: Synthetic oligonucleotide
cctacgggaggcatcaggcagatctcgacaacactccgacaacgctagaatagtcagtcagccggattagataccctagtagtc

SEQ ID NO: 531 - DNA, 84 bp, Artificial Sequence
  Description of Artificial Sequence: Synthetic oligonucleotide
cctacgggaggcatcaggcagatctcgcgatgctgttgaatcagagcccatagtcagtcagccggattagataccctagtagtc

SEQ ID NO: 532 - DNA, 84 bp, Artificial Sequence
  Description of Artificial Sequence: Synthetic oligonucleotide
cctacgggaggcatcaggcagatctcgacgactgcataatctgtagagccaagtcagtcagccggattagataccctagtagtc

SEQ ID NO: 533 - DNA, 84 bp, Artificial Sequence
  Description of Artificial Sequence: Synthetic oligonucleotide
cctacgggaggcatcaggcagatctcgacgcgaactaatccgactctaggtagtcagtcagccggattagataccctagtagtc

SEQ ID NO: 534 - DNA, 84 bp, Artificial Sequence
  Description of Artificial Sequence: Synthetic oligonucleotide
cctacgggaggcatcaggcagatctcgagctatgtatggatcctacgagcaagtcagtcagccggattagataccctagtagtc

SEQ ID NO: 535 - DNA, 84 bp, Artificial Sequence
  Description of Artificial Sequence: Synthetic oligonucleotide
cctacgggaggcatcaggcagatctcgacgggtcatcatgacaacgaatctagtcagtcagccggattagataccctagtagtc

SEQ ID NO: 536 - DNA, 84 bp, Artificial Sequence
  Description of Artificial Sequence: Synthetic oligonucleotide
cctacgggaggcatcaggcagatctcggaaacatcccactgcggttgactcagtcagtcagccggattagataccctagtagtc

SEQ ID NO: 537 - DNA, 84 bp, Artificial Sequence
  Description of Artificial Sequence: Synthetic oligonucleotide
cctacgggaggcatcaggcagatctcgcgtactctcgagtgagaagaaaggagtcagtcagccggattagataccctagtagtc

SEQ ID NO: 538 - DNA, 84 bp, Artificial Sequence
  Description of Artificial Sequence: Synthetic oligonucleotide
cctacgggaggcatcaggcagatctcgtcagttctcgtttcggatctgtgaagtcagtcagccggattagataccctagtagtc

SEQ ID NO: 539 - DNA, 84 bp, Artificial Sequence
  Description of Artificial Sequence: Synthetic oligonucleotide
cctacgggaggcatcaggcagatctcgtcgtgcgtgttggccggtactctaagtcagtcagccggattagataccctagtagtc

SEQ ID NO: 540 - DNA, 84 bp, Artificial Sequence
  Description of Artificial Sequence: Synthetic oligonucleotide
cctacgggaggcatcaggcagatctcggttatcgcatggcacaggattaccagtcagtcagccggattagataccctagtagtc

SEQ ID NO: 541 - DNA, 84 bp, Artificial Sequence
  Description of Artificial Sequence: Synthetic oligonucleotide
cctacgggaggcatcaggcagatctcggatcacgagaggcgatatcagtagagtcagtcagccggattagataccctagtagtc

SEQ ID NO: 542 - DNA, 84 bp, Artificial Sequence
  Description of Artificial Sequence: Synthetic oligonucleotide
cctacgggaggcatcaggcagatctcggtaaattcaggccataagggaggcagtcagtcagccggattagataccctagtagtc

SEQ ID NO: 543 - DNA, 84 bp, Artificial Sequence
  Description of Artificial Sequence: Synthetic oligonucleotide
cctacgggaggcatcaggcagatctcgagtgtttcggactgtgttactcctagtcagtcagccggattagataccctagtagtc

SEQ ID NO: 544 - DNA, 84 bp, Artificial Sequence
  Description of Artificial Sequence: Synthetic oligonucleotide
cctacgggaggcatcaggcagatctcgacacgcggtttaggtacctgcaatagtcagtcagccggattagataccctagtagtc

SEQ ID NO: 545 - DNA, 84 bp, Artificial Sequence
  Description of Artificial Sequence: Synthetic oligonucleotide
cctacgggaggcatcaggcagatctcgtggcaaatctagtcgcctataaggagtcagtcagccggattagataccctagtagtc

SEQ ID NO: 546 - DNA, 84 bp, Artificial Sequence
  Description of Artificial Sequence: Synthetic oligonucleotide
cctacgggaggcatcaggcagatctcgcaccttaccttaagtggcactatcagtcagtcagccggattagataccctagtagtc

SEQ ID NO: 547 - DNA, 84 bp, Artificial Sequence
  Description of Artificial Sequence: Synthetic oligonucleotide
cctacgggaggcatcaggcagatctcgttaaccttcctgtaacccgatagaagtcagtcagccggattagataccctagtagtc

SEQ ID NO: 548 - DNA, 84 bp, Artificial Sequence
  Description of Artificial Sequence: Synthetic oligonucleotide
cctacgggaggcatcaggcagatctcgtgccgtatgccagtgtgctaacgtagtcagtcagccggattagataccctagtagtc

SEQ ID NO: 549 - DNA, 84 bp, Artificial Sequence
  Description of Artificial Sequence: Synthetic oligonucleotide
cctacgggaggcatcaggcagatctcgcgtgacaatagtcttgcggcaatcagtcagtcagccggattagataccctagtagtc

SEQ ID NO: 550 - DNA, 84 bp, Artificial Sequence
  Description of Artificial Sequence: Synthetic oligonucleotide
cctacgggaggcatcaggcagatctcgcgctacaactcgtgaggtttgatgagtcagtcagccggattagataccctagtagtc

SEQ ID NO: 551 - DNA, 84 bp, Artificial Sequence
  Description of Artificial Sequence: Synthetic oligonucleotide
cctacgggaggcatcaggcagatctcgttaagacagtcgattgctggtcgaagtcagtcagccggattagataccctagtagtc

SEQ ID NO: 552 - DNA, 84 bp, Artificial Sequence
  Description of Artificial Sequence: Synthetic oligonucleotide
cctacgggaggcatcaggcagatctcgtctgcactgagcaagaagccggacagtcagtcagccggattagataccctagtagtc

SEQ ID NO: 553 - DNA, 84 bp, Artificial Sequence
  Description of Artificial Sequence: Synthetic oligonucleotide
cctacgggaggcatcaggcagatctcgcgcagattagtaacgggatacaggagtcagtcagccggattagataccctagtagtc

SEQ ID NO: 554 - DNA, 84 bp, Artificial Sequence
  Description of Artificial Sequence: Synthetic oligonucleotide
cctacgggaggcatcaggcagatctcgtgggtcccacataagagtctctagagtcagtcagccggattagataccctagtagtc

SEQ ID NO: 555 - DNA, 84 bp, Artificial Sequence
  Description of Artificial Sequence: Synthetic oligonucleotide
cctacgggaggcatcaggcagatctcgcactggtgcatatccgtcatgggtagtcagtcagccggattagataccctagtagtc

SEQ ID NO: 556 - DNA, 84 bp, Artificial Sequence
  Description of Artificial Sequence: Synthetic oligonucleotide
cctacgggaggcatcaggcagatctcgaacgtaggctctagatctatgcagagtcagtcagccggattagataccctagtagtc

SEQ ID NO: 557 - DNA, 84 bp, Artificial Sequence
  Description of Artificial Sequence: Synthetic oligonucleotide
cctacgggaggcatcaggcagatctcgagttgtagtccggcacaaggcaagagtcagtcagccggattagataccctagtagtc

SEQ ID NO: 558 - DNA, 84 bp, Artificial Sequence
  Description of Artificial Sequence: Synthetic oligonucleotide
cctacgggaggcatcaggcagatctcgtcgtcaaacccgcggcaaacacttagtcagtcagccggattagataccctagtagtc

SEQ ID NO: 559 - DNA, 84 bp, Artificial Sequence
  Description of Artificial Sequence: Synthetic oligonucleotide
cctacgggaggcatcaggcagatctcgtaatcggtgccagcgagttcctgtagtcagtcagccggattagataccctagtagtc

SEQ ID NO: 560 - DNA, 84 bp, Artificial Sequence
  Description of Artificial Sequence: Synthetic oligonucleotide
cctacgggaggcatcaggcagatctcgttgatccggtagttccgaatcggcagtcagtcagccggattagataccctagtagtc

SEQ ID NO: 561 - DNA, 84 bp, Artificial Sequence
  Description of Artificial Sequence: Synthetic oligonucleotide
cctacgggaggcatcaggcagatctcgcgggtgtttgcttacctagtgagaagtcagtcagccggattagataccctagtagtc

SEQ ID NO: 562 - DNA, 84 bp, Artificial Sequence
  Description of Artificial Sequence: Synthetic oligonucleotide
cctacgggaggcatcaggcagatctcgttgaccgcggttcgttctggtggtagtcagtcagccggattagataccctagtagtc

SEQ ID NO: 563 - DNA, 84 bp, Artificial Sequence
  Description of Artificial Sequence: Synthetic oligonucleotide
cctacgggaggcatcaggcagatctcggtgcaaccaatcttggtctcctctagtcagtcagccggattagataccctagtagtc

SEQ ID NO: 564 - DNA, 84 bp, Artificial Sequence
  Description of Artificial Sequence: Synthetic oligonucleotide
cctacgggaggcatcaggcagatctcggcttgagcttgactgcatactgagagtcagtcagccggattagataccctagtagtc

SEQ ID NO: 565 - DNA, 84 bp, Artificial Sequence
  Description of Artificial Sequence: Synthetic oligonucleotide
cctacgggaggcatcaggcagatctcgcgctgtggattacagggcctttgtagtcagtcagccggattagataccctagtagtc

SEQ ID NO: 566 - DNA, 84 bp, Artificial Sequence
  Description of Artificial Sequence: Synthetic oligonucleotide
cctacgggaggcatcaggcagatctcgctgtcagtgacccgatgaatatcgagtcagtcagccggattagataccctagtagtc

SEQ ID NO: 567 - DNA, 84 bp, Artificial Sequence
  Description of Artificial Sequence: Synthetic oligonucleotide
cctacgggaggcatcaggcagatctcgacgattcgagtcgtcaattagtggagtcagtcagccggattagataccctagtagtc

SEQ ID NO: 568 - DNA, 84 bp, Artificial Sequence
  Description of Artificial Sequence: Synthetic oligonucleotide
cctacgggaggcatcaggcagatctcgggttcggtccatagtacgcagtctagtcagtcagccggattagataccctagtagtc

SEQ ID NO: 569 - DNA, 84 bp, Artificial Sequence
  Description of Artificial Sequence: Synthetic oligonucleotide
cctacgggaggcatcaggcagatctcgctgatccatcttagcagctattgcagtcagtcagccggattagataccctagtagtc

SEQ ID NO: 570 - DNA, 84 bp, Artificial Sequence
  Description of Artificial Sequence: Synthetic oligonucleotide
cctacgggaggcatcaggcagatctcgtatgtgccggctctcggatagatcagtcagtcagccggattagataccctagtagtc

SEQ ID NO: 571 - DNA, 84 bp, Artificial Sequence
  Description of Artificial Sequence: Synthetic oligonucleotide
cctacgggaggcatcaggcagatctcgtggtcgcatcgtttcccgaaacgaagtcagtcagccggattagataccctagtagtc

SEQ ID NO: 572 - DNA, 84 bp, Artificial Sequence
  Description of Artificial Sequence: Synthetic oligonucleotide
cctacgggaggcatcaggcagatctcgtgtaagacttgggaactttagcgcagtcagtcagccggattagataccctagtagtc

SEQ ID NO: 573 - DNA, 84 bp, Artificial Sequence
  Description of Artificial Sequence: Synthetic oligonucleotide
cctacgggaggcatcaggcagatctcgcggatctagtgttccttagaaggcagtcagtcagccggattagataccctagtagtc

SEQ ID NO: 574 - DNA, 84 bp, Artificial Sequence
  Description of Artificial Sequence: Synthetic oligonucleotide
cctacgggaggcatcaggcagatctcgcgatcttcgagcgatggacttcaaagtcagtcagccggattagataccctagtagtc

SEQ ID NO: 575 - DNA, 84 bp, Artificial Sequence
  Description of Artificial Sequence: Synthetic oligonucleotide
cctacgggaggcatcaggcagatctcggtcgaatttgcgtactgagcctcgagtcagtcagccggattagataccctagtagtc

SEQ ID NO: 576 - DNA, 84 bp, Artificial Sequence
  Description of Artificial Sequence: Synthetic oligonucleotide
cctacgggaggcatcaggcagatctcggcatcagagttaagaaggccttatagtcagtcagccggattagataccctagtagtc

SEQ ID NO: 577 - DNA, 84 bp, Artificial Sequence
  Description of Artificial Sequence: Synthetic oligonucleotide
cctacgggaggcatcaggcagatctcggtggtcatcgtatggagccttgtcagtcagtcagccggattagataccctagtagtc

SEQ ID NO: 578 - DNA, 84 bp, Artificial Sequence
  Description of Artificial Sequence: Synthetic oligonucleotide
cctacgggaggcatcaggcagatctcgctgaagggcgaactcgatgtaagcagtcagtcagccggattagataccctagtagtc

SEQ ID NO: 579 - DNA, 84 bp, Artificial Sequence
  Description of Artificial Sequence: Synthetic oligonucleotide
cctacgggaggcatcaggcagatctcgcgctcacagaatagcttcgacagtagtcagtcagccggattagataccctagtagtc

SEQ ID NO: 580 - DNA, 84 bp, Artificial Sequence
  Description of Artificial Sequence: Synthetic oligonucleotide
cctacgggaggcatcaggcagatctcgattcggtagtgcatacgcatcaagagtcagtcagccggattagataccctagtagtc

SEQ ID NO: 581 - DNA, 84 bp, Artificial Sequence
  Description of Artificial Sequence: Synthetic oligonucleotide
cctacgggaggcatcaggcagatctcgcgagctgttaccagatgtccgtcaagtcagtcagccggattagataccctagtagtc

SEQ ID NO: 582 - DNA, 84 bp, Artificial Sequence
  Description of Artificial Sequence: Synthetic oligonucleotide
cctacgggaggcatcaggcagatctcgcaacacatgctggcacctgttgaaagtcagtcagccggattagataccctagtagtc

SEQ ID NO: 583 - DNA, 84 bp, Artificial Sequence
  Description of Artificial Sequence: Synthetic oligonucleotide
cctacgggaggcatcaggcagatctcgattctctcacgtcctagagaaactagtcagtcagccggattagataccctagtagtc

SEQ ID NO: 584 - DNA, 84 bp, Artificial Sequence
  Description of Artificial Sequence: Synthetic oligonucleotide
cctacgggaggcatcaggcagatctcgcgactctaaacggaggttcttgacagtcagtcagccggattagataccctagtagtc

SEQ ID NO: 585 - DNA, 84 bp, Artificial Sequence
  Description of Artificial Sequence: Synthetic oligonucleotide
cctacgggaggcatcaggcagatctcggtcttcagcaagctgtaaaggttgagtcagtcagccggattagataccctagtagtc

SEQ ID NO: 586 - DNA, 84 bp, Artificial Sequence
  Description of Artificial Sequence: Synthetic oligonucleotide
cctacgggaggcatcaggcagatctcgcggataacctcctgagtcattgagagtcagtcagccggattagataccctagtagtc

SEQ ID NO: 587 - DNA, 84 bp, Artificial Sequence
  Description of Artificial Sequence: Synthetic oligonucleotide
cctacgggaggcatcaggcagatctcgagggtgactttatacggcagttcaagtcagtcagccggattagataccctagtagtc

SEQ ID NO: 588 - DNA, 84 bp, Artificial Sequence
  Description of Artificial Sequence: Synthetic oligonucleotide
cctacgggaggcatcaggcagatctcggacttcatgcgactctagaagagtagtcagtcagccggattagataccctagtagtc

SEQ ID NO: 589 - DNA, 84 bp, Artificial Sequence
  Description of Artificial Sequence: Synthetic oligonucleotide
cctacgggaggcatcaggcagatctcggcctgtctgcaatgcacagtcgctagtcagtcagccggattagataccctagtagtc

SEQ ID NO: 590 - DNA, 84 bp, Artificial Sequence
  Description of Artificial Sequence: Synthetic oligonucleotide
cctacgggaggcatcaggcagatctcgactgatggcctccatgcggatcctagtcagtcagccggattagataccctagtagtc

SEQ ID NO: 591 - DNA, 84 bp, Artificial Sequence
  Description of Artificial Sequence: Synthetic oligonucleotide
cctacgggaggcatcaggcagatctcgttcgatgccgcatgctccgtagaaagtcagtcagccggattagataccctagtagtc

SEQ ID NO: 592 - DNA, 84 bp, Artificial Sequence
  Description of Artificial Sequence: Synthetic oligonucleotide
cctacgggaggcatcaggcagatctcgtgtggctcgtgttgataggtacacagtcagtcagccggattagataccctagtagtc

SEQ ID NO: 593 - DNA, 84 bp, Artificial Sequence
  Description of Artificial Sequence: Synthetic oligonucleotide
cctacgggaggcatcaggcagatctcgaactttcaggagcgagttcatcgaagtcagtcagccggattagataccctagtagtc

SEQ ID NO: 594 - DNA, 84 bp, Artificial Sequence
  Description of Artificial Sequence: Synthetic oligonucleotide
cctacgggaggcatcaggcagatctcgtgcacgtgataaaagcagattgtcagtcagtcagccggattagataccctagtagtc

SEQ ID NO: 595 - DNA, 84 bp, Artificial Sequence
  Description of Artificial Sequence: Synthetic oligonucleotide
cctacgggaggcatcaggcagatctcggttcggtgtccatagaggcgtaggagtcagtcagccggattagataccctagtagtc

SEQ ID NO: 596 - DNA, 84 bp, Artificial Sequence
  Description of Artificial Sequence: Synthetic oligonucleotide
cctacgggaggcatcaggcagatctcgaagacagctatctcagcgccgttaagtcagtcagccggattagataccctagtagtc

SEQ ID NO: 597 - DNA, 84 bp, Artificial Sequence
  Description of Artificial Sequence: Synthetic oligonucleotide
cctacgggaggcatcaggcagatctcgattgaccggtcatagaccgactccagtcagtcagccggattagataccctagtagtc

SEQ ID NO: 598 - DNA, 84 bp, Artificial Sequence
  Description of Artificial Sequence: Synthetic oligonucleotide
cctacgggaggcatcaggcagatctcgttctccatcacagtcaacgctgtcagtcagtcagccggattagataccctagtagtc

SEQ ID NO: 599 - DNA, 84 bp, Artificial Sequence
  Description of Artificial Sequence: Synthetic oligonucleotide
cctacgggaggcatcaggcagatctcgcgtaggtagaggacaggagggtgtagtcagtcagccggattagataccctagtagtc

SEQ ID NO: 600 - DNA, 84 bp, Artificial Sequence
  Description of Artificial Sequence: Synthetic oligonucleotide
cctacgggaggcatcaggcagatctcgatttaggacgacgctgtcgtcaacagtcagtcagccggattagataccctagtagtc

SEQ ID NO: 601 - DNA, 84 bp, Artificial Sequence
  Description of Artificial Sequence: Synthetic oligonucleotide
cctacgggaggcatcaggcagatctcgggatagccaaggatagaggccattagtcagtcagccggattagataccctagtagtc

SEQ ID NO: 602 - DNA, 84 bp, Artificial Sequence
  Description of Artificial Sequence: Synthetic oligonucleotide
cctacgggaggcatcaggcagatctcgtggttggttacgaagcttgaaaccagtcagtcagccggattagataccctagtagtc

SEQ ID NO: 603 - DNA, 84 bp, Artificial Sequence
  Description of Artificial Sequence: Synthetic oligonucleotide
cctacgggaggcatcaggcagatctcggtcgtccaaatgtaagcgtctcgaagtcagtcagccggattagataccctagtagtc

SEQ ID NO: 604 - DNA, 84 bp, Artificial Sequence
  Description of Artificial Sequence: Synthetic oligonucleotide
cctacgggaggcatcaggcagatctcgcaacgtgctccaatagcttcgtggagtcagtcagccggattagataccctagtagtc

SEQ ID NO: 605 - DNA, 84 bp, Artificial Sequence
  Description of Artificial Sequence: Synthetic oligonucleotide
cctacgggaggcatcaggcagatctcgtacacaagtcgccgggatcaaattagtcagtcagccggattagataccctagtagtc

SEQ ID NO: 606 - DNA, 84 bp, Artificial Sequence
  Description of Artificial Sequence: Synthetic oligonucleotide
cctacgggaggcatcaggcagatctcggcgtccatgaatagtcatcgaatgagtcagtcagccggattagataccctagtagtc

SEQ ID NO: 607 - DNA, 84 bp, Artificial Sequence
  Description of Artificial Sequence: Synthetic oligonucleotide
cctacgggaggcatcaggcagatctcggtaatgcgtaacatcttggagtcgagtcagtcagccggattagataccctagtagtc

SEQ ID NO: 608 - DNA, 84 bp, Artificial Sequence
  Description of Artificial Sequence: Synthetic oligonucleotide
cctacgggaggcatcaggcagatctcggtcgccgtacatagcaccggtcttagtcagtcagccggattagataccctagtagtc

SEQ ID NO: 609 - DNA, 84 bp, Artificial Sequence
  Description of Artificial Sequence: Synthetic oligonucleotide
cctacgggaggcatcaggcagatctcgggaatccgattagcaaatcagcctagtcagtcagccggattagataccctagtagtc

SEQ ID NO: 610 - DNA, 84 bp, Artificial Sequence
  Description of Artificial Sequence: Synthetic oligonucleotide
cctacgggaggcatcaggcagatctcgcacccgatggttgcaagctgtctcagtcagtcagccggattagataccctagtagtc

SEQ ID NO: 611 - DNA, 84 bp, Artificial Sequence
  Description of Artificial Sequence: Synthetic oligonucleotide
cctacgggaggcatcaggcagatctcgttctgagaggtaagcggcctattaagtcagtcagccggattagataccctagtagtc

SEQ ID NO: 612 - DNA, 84 bp, Artificial Sequence
  Description of Artificial Sequence: Synthetic oligonucleotide
cctacgggaggcatcaggcagatctcgatccctacggaatcttcaactaccagtcagtcagccggattagataccctagtagtc

SEQ ID NO: 613 - DNA, 84 bp, Artificial Sequence
  Description of Artificial Sequence: Synthetic oligonucleotide
cctacgggaggcatcaggcagatctcgggttccattaggtggaattcggctagtcagtcagccggattagataccctagtagtc

SEQ ID NO: 614 - DNA, 84 bp, Artificial Sequence
  Description of Artificial Sequence: Synthetic oligonucleotide
cctacgggaggcatcaggcagatctcggtgttcccagaataagatgcagtcagtcagtcagccggattagataccctagtagtc

SEQ ID NO: 615 - DNA, 84 bp, Artificial Sequence
  Description of Artificial Sequence: Synthetic oligonucleotide
cctacgggaggcatcaggcagatctcgccgaggtataattgccgagtaatcagtcagtcagccggattagataccctagtagtc

SEQ ID NO: 616 - DNA, 84 bp, Artificial Sequence
  Description of Artificial Sequence: Synthetic oligonucleotide
cctacgggaggcatcaggcagatctcgagcgtaattagcaccttgacaagaagtcagtcagccggattagataccctagtagtc

SEQ ID NO: 617 - DNA, 84 bp, Artificial Sequence
  Description of Artificial Sequence: Synthetic oligonucleotide
cctacgggaggcatcaggcagatctcgctcgtgaatgacgtaaccaccaccagtcagtcagccggattagataccctagtagtc

SEQ ID NO: 618 - DNA, 84 bp, Artificial Sequence
  Description of Artificial Sequence: Synthetic oligonucleotide
cctacgggaggcatcaggcagatctcgaggtgagttctacatagctcggtcagtcagtcagccggattagataccctagtagtc

SEQ ID NO: 619 - DNA, 84 bp, Artificial Sequence
  Description of Artificial Sequence: Synthetic oligonucleotide
cctacgggaggcatcaggcagatctcgcctgtcctatctaaccatgccaacagtcagtcagccggattagataccctagtagtc

SEQ ID NO: 620 - DNA, 84 bp, Artificial Sequence
  Description of Artificial Sequence: Synthetic oligonucleotide
cctacgggaggcatcaggcagatctcgggtttaacacgctatggagctagtagtcagtcagccggattagataccctagtagtc

SEQ ID NO: 621 - DNA, 84 bp, Artificial Sequence
  Description of Artificial Sequence: Synthetic oligonucleotide
cctacgggaggcatcaggcagatctcgagacagtaggagactacctcttcaagtcagtcagccggattagataccctagtagtc

SEQ ID NO: 622 - DNA, 84 bp, Artificial Sequence
  Description of Artificial Sequence: Synthetic oligonucleotide
cctacgggaggcatcaggcagatctcggccacgacttacgatgataacccaagtcagtcagccggattagataccctagtagtc

SEQ ID NO: 623 - DNA, 84 bp, Artificial Sequence
  Description of Artificial Sequence: Synthetic oligonucleotide
cctacgggaggcatcaggcagatctcgattgttcctaccggcccaatataaagtcagtcagccggattagataccctagtagtc

SEQ ID NO: 624 - DNA, 84 bp, Artificial Sequence
  Description of Artificial Sequence: Synthetic oligonucleotide
cctacgggaggcatcaggcagatctcggccgtaaacttgttgtatgacaggagtcagtcagccggattagataccctagtagtc

SEQ ID NO: 625 - DNA, 84 bp, Artificial Sequence
  Description of Artificial Sequence: Synthetic oligonucleotide
cctacgggaggcatcaggcagatctcggcagatttccagggtaagtttgacagtcagtcagccggattagataccctagtagtc

SEQ ID NO: 626 - DNA, 84 bp, Artificial Sequence
  Description of Artificial Sequence: Synthetic oligonucleotide
cctacgggaggcatcaggcagatctcgagatgatcagtcctaccacggtacagtcagtcagccggattagataccctagtagtc

SEQ ID NO: 627 - DNA, 84 bp, Artificial Sequence
  Description of Artificial Sequence: Synthetic oligonucleotide
cctacgggaggcatcaggcagatctcggagacgtgttctcggtctgtctgaagtcagtcagccggattagataccctagtagtc

SEQ ID NO: 628 - DNA, 84 bp, Artificial Sequence
  Description of Artificial Sequence: Synthetic oligonucleotide
cctacgggaggcatcaggcagatctcgtatcaccggcacgtacatgtcgccagtcagtcagccggattagataccctagtagtc

SEQ ID NO: 629 - DNA, 84 bp, Artificial Sequence
  Description of Artificial Sequence: Synthetic oligonucleotide
cctacgggaggcatcaggcagatctcgtatgccagagatttctagagtgcgagtcagtcagccggattagataccctagtagtc

SEQ ID NO: 630 - DNA, 84 bp, Artificial Sequence
  Description of Artificial Sequence: Synthetic oligonucleotide
cctacgggaggcatcaggcagatctcgaggtccaaatcaacggatgttatgagtcagtcagccggattagataccctagtagtc

SEQ ID NO: 631 - DNA, 84 bp, Artificial Sequence
  Description of Artificial Sequence: Synthetic oligonucleotide
cctacgggaggcatcaggcagatctcgaccgtgctcacattgaggctacaaagtcagtcagccggattagataccctagtagtc

SEQ ID NO: 632 - DNA, 84 bp, Artificial Sequence
  Description of Artificial Sequence: Synthetic oligonucleotide
cctacgggaggcatcaggcagatctcgctccctttgtgtgtaggaaccggaagtcagtcagccggattagataccctagtagtc

SEQ ID NO: 633 - DNA, 84 bp, Artificial Sequence
  Description of Artificial Sequence: Synthetic oligonucleotide
cctacgggaggcatcaggcagatctcgagctgcacctaaacatctagcagaagtcagtcagccggattagataccctagtagtc

SEQ ID NO: 634 - DNA, 84 bp, Artificial Sequence
  Description of Artificial Sequence: Synthetic oligonucleotide
cctacgggaggcatcaggcagatctcgccttgaccgatgccgacattgtagagtcagtcagccggattagataccctagtagtc

SEQ ID NO: 635 - DNA, 84 bp, Artificial Sequence
  Description of Artificial Sequence: Synthetic oligonucleotide
cctacgggaggcatcaggcagatctcgctatcatcctcacatgtaaggctcagtcagtcagccggattagataccctagtagtc

SEQ ID NO: 636 - DNA, 84 bp, Artificial Sequence
  Description of Artificial Sequence: Synthetic oligonucleotide
cctacgggaggcatcaggcagatctcgactctagccggttgcaagctaagtagtcagtcagccggattagataccctagtagtc

SEQ ID NO: 637 - DNA, 84 bp, Artificial Sequence
  Description of Artificial Sequence: Synthetic oligonucleotide
cctacgggaggcatcaggcagatctcgcgataggccttagtgtgtgccataagtcagtcagccggattagataccctagtagtc

SEQ ID NO: 638 - DNA, 84 bp, Artificial Sequence
  Description of Artificial Sequence: Synthetic oligonucleotide
cctacgggaggcatcaggcagatctcgaatgacctcgtgtgacaaccgaatagtcagtcagccggattagataccctagtagtc

SEQ ID NO: 639 - DNA, 84 bp, Artificial Sequence
  Description of Artificial Sequence: Synthetic oligonucleotide
cctacgggaggcatcaggcagatctcgcttaggcatgtgtaggctcgtgctagtcagtcagccggattagataccctagtagtc

SEQ ID NO: 640 - DNA, 84 bp, Artificial Sequence
  Description of Artificial Sequence: Synthetic oligonucleotide
cctacgggaggcatcaggcagatctcgccagatatagcactccttaaggcgagtcagtcagccggattagataccctagtagtc

SEQ ID NO: 641 - DNA, 84 bp, Artificial Sequence
  Description of Artificial Sequence: Synthetic oligonucleotide
cctacgggaggcatcaggcagatctcggagagtccacttttgcctgggtcaagtcagtcagccggattagataccctagtagtc

SEQ ID NO: 642 - DNA, 84 bp, Artificial Sequence
  Description of Artificial Sequence: Synthetic oligonucleotide
cctacgggaggcatcaggcagatctcggaacgggacgtacaattctgcttcagtcagtcagccggattagataccctagtagtc

SEQ ID NO: 643 - DNA, 84 bp, Artificial Sequence
  Description of Artificial Sequence: Synthetic oligonucleotide
cctacgggaggcatcaggcagatctcgacgtgtaggcttactggcaaacctagtcagtcagccggattagataccctagtagtc

SEQ ID NO: 644 - DNA, 84 bp, Artificial Sequence
  Description of Artificial Sequence: Synthetic oligonucleotide
cctacgggaggcatcaggcagatctcgggtctcctacagaatcagagcttgagtcagtcagccggattagataccctagtagtc

SEQ ID NO: 645 - DNA, 84 bp, Artificial Sequence
  Description of Artificial Sequence: Synthetic oligonucleotide
cctacgggaggcatcaggcagatctcgactgacttaaggcaatgtagacacagtcagtcagccggattagataccctagtagtc

SEQ ID NO: 646 - DNA, 84 bp, Artificial Sequence
  Description of Artificial Sequence: Synthetic oligonucleotide
cctacgggaggcatcaggcagatctcggatgctgccgtttggcgatacgttagtcagtcagccggattagataccctagtagtc

SEQ ID NO: 647 - DNA, 84 bp, Artificial Sequence
  Description of Artificial Sequence: Synthetic oligonucleotide
cctacgggaggcatcaggcagatctcgttcctaggccaggccttacgatagagtcagtcagccggattagataccctagtagtc

SEQ ID NO: 648 - DNA, 84 bp, Artificial Sequence
  Description of Artificial Sequence: Synthetic oligonucleotide
cctacgggaggcatcaggcagatctcgattaagcctggatacctgtgtcttagtcagtcagccggattagataccctagtagtc

SEQ ID NO: 649 - DNA, 84 bp, Artificial Sequence
  Description of Artificial Sequence: Synthetic oligonucleotide
cctacgggaggcatcaggcagatctcgtggctttctatcaacgaggcaacgagtcagtcagccggattagataccctagtagtc

SEQ ID NO: 650 - DNA, 84 bp, Artificial Sequence
  Description of Artificial Sequence: Synthetic oligonucleotide
cctacgggaggcatcaggcagatctcgacagctcaaacagaagacagcgacagtcagtcagccggattagataccctagtagtc

SEQ ID NO: 651 - DNA, 84 bp, Artificial Sequence
  Description of Artificial Sequence: Synthetic oligonucleotide
cctacgggaggcatcaggcagatctcggagcgtatccatacacctgcgatcagtcagtcagccggattagataccctagtagtc

SEQ ID NO: 652 - DNA, 84 bp, Artificial Sequence
  Description of Artificial Sequence: Synthetic oligonucleotide
cctacgggaggcatcaggcagatctcgatgggcgaatggggcgttgcattcagtcagtcagccggattagataccctagtagtc

SEQ ID NO: 653 - DNA, 84 bp, Artificial Sequence
  Description of Artificial Sequence: Synthetic oligonucleotide
cctacgggaggcatcaggcagatctcggatctctgggtaactagcgttcagagtcagtcagccggattagataccctagtagtc

SEQ ID NO: 654 - DNA, 84 bp, Artificial Sequence
  Description of Artificial Sequence: Synthetic oligonucleotide
cctacgggaggcatcaggcagatctcgcatcatacgggtttgcgacaaagtagtcagtcagccggattagataccctagtagtc

SEQ ID NO: 655 - DNA, 84 bp, Artificial Sequence
  Description of Artificial Sequence: Synthetic oligonucleotide
cctacgggaggcatcaggcagatctcgtacggattatggtgcgagtatatgagtcagtcagccggattagataccctagtagtc

SEQ ID NO: 656 - DNA, 84 bp, Artificial Sequence
  Description of Artificial Sequence: Synthetic oligonucleotide
cctacgggaggcatcaggcagatctcgatagcgaactcataccacaacgaaagtcagtcagccggattagataccctagtagtc

SEQ ID NO: 657 - DNA, 84 bp, Artificial Sequence
  Description of Artificial Sequence: Synthetic oligonucleotide
cctacgggaggcatcaggcagatctcgtaacgctgtgtgtctggaacggttagtcagtcagccggattagataccctagtagtc

SEQ ID NO: 658 - DNA, 84 bp, Artificial Sequence
  Description of Artificial Sequence: Synthetic oligonucleotide
cctacgggaggcatcaggcagatctcgaaccaaactcgagtactacctcggagtcagtcagccggattagataccctagtagtc

SEQ ID NO: 659 - DNA, 84 bp, Artificial Sequence
  Description of Artificial Sequence: Synthetic oligonucleotide
cctacgggaggcatcaggcagatctcggccgtctcgtaattcctgttaaccagtcagtcagccggattagataccctagtagtc

SEQ ID NO: 660 - DNA, 84 bp, Artificial Sequence
  Description of Artificial Sequence: Synthetic oligonucleotide
cctacgggaggcatcaggcagatctcgctgggtatctcgctatccaagtggagtcagtcagccggattagataccctagtagtc

SEQ ID NO: 661 - DNA, 84 bp, Artificial Sequence
  Description of Artificial Sequence: Synthetic oligonucleotide
cctacgggaggcatcaggcagatctcggactacccgttgcagtctagtacgagtcagtcagccggattagataccctagtagtc

SEQ ID NO: 662 - DNA, 84 bp, Artificial Sequence
  Description of Artificial Sequence: Synthetic oligonucleotide
cctacgggaggcatcaggcagatctcggcgttgcaaactgtgtccggattcagtcagtcagccggattagataccctagtagtc

SEQ ID NO: 663 - DNA, 84 bp, Artificial Sequence
  Description of Artificial Sequence: Synthetic oligonucleotide
cctacgggaggcatcaggcagatctcgaaccgcataagttgtggtgatgtaagtcagtcagccggattagataccctagtagtc

SEQ ID NO: 664 - DNA, 84 bp, Artificial Sequence
  Description of Artificial Sequence: Synthetic oligonucleotide
cctacgggaggcatcaggcagatctcgaccttacaccttctttcgttcaacagtcagtcagccggattagataccctagtagtc

SEQ ID NO: 665 - DNA, 84 bp, Artificial Sequence
  Description of Artificial Sequence: Synthetic oligonucleotide
cctacgggaggcatcaggcagatctcggtaggtgcttacccgaagattctgagtcagtcagccggattagataccctagtagtc

SEQ ID NO: 666 - DNA, 84 bp, Artificial Sequence
  Description of Artificial Sequence: Synthetic oligonucleotide
cctacgggaggcatcaggcagatctcgcgcatttggatggttggcgttacaagtcagtcagccggattagataccctagtagtc

SEQ ID NO: 667 - DNA, 84 bp, Artificial Sequence
  Description of Artificial Sequence: Synthetic oligonucleotide
cctacgggaggcatcaggcagatctcgataacatgtgcggaagtagcgagcagtcagtcagccggattagataccctagtagtc

SEQ ID NO: 668 - DNA, 84 bp, Artificial Sequence
  Description of Artificial Sequence: Synthetic oligonucleotide
cctacgggaggcatcaggcagatctcgcttgagaaatcgttgcggaccctaagtcagtcagccggattagataccctagtagtc

SEQ ID NO: 669 - DNA, 84 bp, Artificial Sequence
  Description of Artificial Sequence: Synthetic oligonucleotide
cctacgggaggcatcaggcagatctcgctacacagcacagcggaaacatggagtcagtcagccggattagataccctagtagtc

SEQ ID NO: 670 - DNA, 84 bp, Artificial Sequence
  Description of Artificial Sequence: Synthetic oligonucleotide
cctacgggaggcatcaggcagatctcggaaatgctacgtaacgttagtgtgagtcagtcagccggattagataccctagtagtc

SEQ ID NO: 671 - DNA, 84 bp, Artificial Sequence
  Description of Artificial Sequence: Synthetic oligonucleotide
cctacgggaggcatcaggcagatctcgtctgaggttgcctgcatgacagtcagtcagtcagccggattagataccctagtagtc

SEQ ID NO: 672 - DNA, 84 bp, Artificial Sequence
  Description of Artificial Sequence: Synthetic oligonucleotide
cctacgggaggcatcaggcagatctcggatcattctctctcaatcgctttcagtcagtcagccggattagataccctagtagtc

SEQ ID NO: 673 - DNA, 84 bp, Artificial Sequence
  Description of Artificial Sequence: Synthetic oligonucleotide
cctacgggaggcatcaggcagatctcgagacataccgtactaccgattgcgagtcagtcagccggattagataccctagtagtc

SEQ ID NO: 674 - DNA, 84 bp, Artificial Sequence
  Description of Artificial Sequence: Synthetic oligonucleotide
cctacgggaggcatcaggcagatctcggatcctcatgcgtcacccaaggtaagtcagtcagccggattagataccctagtagtc

SEQ ID NO: 675 - DNA, 84 bp, Artificial Sequence
  Description of Artificial Sequence: Synthetic oligonucleotide
cctacgggaggcatcaggcagatctcgattatcgtccctagccagtcatacagtcagtcagccggattagataccctagtagtc

SEQ ID NO: 676 - DNA, 84 bp, Artificial Sequence
  Description of Artificial Sequence: Synthetic oligonucleotide
cctacgggaggcatcaggcagatctcgccagaccgctattaacggcgctctagtcagtcagccggattagataccctagtagtc

SEQ ID NO: 677 - DNA, 84 bp, Artificial Sequence
  Description of Artificial Sequence: Synthetic oligonucleotide
cctacgggaggcatcaggcagatctcgagctctagaaacgtttgctcgagaagtcagtcagccggattagataccctagtagtc

SEQ ID NO: 678 - DNA, 84 bp, Artificial Sequence
  Description of Artificial Sequence: Synthetic oligonucleotide
cctacgggaggcatcaggcagatctcgtccatcgacgtgcaaacgcactaaagtcagtcagccggattagataccctagtagtc

SEQ ID NO: 679 - DNA, 84 bp, Artificial Sequence
  Description of Artificial Sequence: Synthetic oligonucleotide
cctacgggaggcatcaggcagatctcgcgatgtgtggttgaacaaagagcgagtcagtcagccggattagataccctagtagtc

SEQ ID NO: 680 - DNA, 84 bp, Artificial Sequence
  Description of Artificial Sequence: Synthetic oligonucleotide
cctacgggaggcatcaggcagatctcggcgaagttgggagctaagtgatgtagtcagtcagccggattagataccctagtagtc

SEQ ID NO: 681 - DNA, 84 bp, Artificial Sequence
  Description of Artificial Sequence: Synthetic oligonucleotide
cctacgggaggcatcaggcagatctcggcattcggcgttaagggacaagtgagtcagtcagccggattagataccctagtagtc

SEQ ID NO: 682 - DNA, 84 bp, Artificial Sequence
  Description of Artificial Sequence: Synthetic oligonucleotide
cctacgggaggcatcaggcagatctcgcgccattgtgcaagtgtcgattcgagtcagtcagccggattagataccctagtagtc

SEQ ID NO: 683 - DNA, 84 bp, Artificial Sequence
  Description of Artificial Sequence: Synthetic oligonucleotide
cctacgggaggcatcaggcagatctcgtccaactgcagactattaagcggcagtcagtcagccggattagataccctagtagtc

SEQ ID NO: 684 - DNA, 84 bp, Artificial Sequence
  Description of Artificial Sequence: Synthetic oligonucleotide
cctacgggaggcatcaggcagatctcgtaaagacccgtacctaccattgttagtcagtcagccggattagataccctagtagtc

SEQ ID NO: 685 - DNA, 84 bp, Artificial Sequence
  Description of Artificial Sequence: Synthetic oligonucleotide
cctacgggaggcatcaggcagatctcgtgtatcttcaccgagtccgttgctagtcagtcagccggattagataccctagtagtc

SEQ ID NO: 686 - DNA, 84 bp, Artificial Sequence
  Description of Artificial Sequence: Synthetic oligonucleotide
cctacgggaggcatcaggcagatctcggactgactcgtcgataactgtacgagtcagtcagccggattagataccctagtagtc

SEQ ID NO: 687 - DNA, 84 bp, Artificial Sequence
  Description of Artificial Sequence: Synthetic oligonucleotide
cctacgggaggcatcaggcagatctcgtcgtggatagcttaaacctggacaagtcagtcagccggattagataccctagtagtc

SEQ ID NO: 688 - DNA, 84 bp, Artificial Sequence
  Description of Artificial Sequence: Synthetic oligonucleotide
cctacgggaggcatcaggcagatctcggacgcactaactccgaattgacaaagtcagtcagccggattagataccctagtagtc

SEQ ID NO: 689 - DNA, 84 bp, Artificial Sequence
  Description of Artificial Sequence: Synthetic oligonucleotide
cctacgggaggcatcaggcagatctcgggcgatttacgtctggcatctagcagtcagtcagccggattagataccctagtagtc

SEQ ID NO: 690 - DNA, 84 bp, Artificial Sequence
  Description of Artificial Sequence: Synthetic oligonucleotide
cctacgggaggcatcaggcagatctcgtaaggcatcgctggtggtcgttctagtcagtcagccggattagataccctagtagtc

SEQ ID NO: 691 - DNA, 84 bp, Artificial Sequence
  Description of Artificial Sequence: Synthetic oligonucleotide
cctacgggaggcatcaggcagatctcgacccatacagccactatgggctaaagtcagtcagccggattagataccctagtagtc

SEQ ID NO: 692 - DNA, 84 bp, Artificial Sequence
  Description of Artificial Sequence: Synthetic oligonucleotide
cctacgggaggcatcaggcagatctcgcgcactacgcatgcattgagttcgagtcagtcagccggattagataccctagtagtc

SEQ ID NO: 693 - DNA, 84 bp, Artificial Sequence
  Description of Artificial Sequence: Synthetic oligonucleotide
cctacgggaggcatcaggcagatctcgcagtcgttaagagttgctgagtccagtcagtcagccggattagataccctagtagtc

SEQ ID NO: 694 - DNA, 84 bp, Artificial Sequence
  Description of Artificial Sequence: Synthetic oligonucleotide
cctacgggaggcatcaggcagatctcgctacgaaagcctctatggtgaaccagtcagtcagccggattagataccctagtagtc

SEQ ID NO: 695 - DNA, 84 bp, Artificial Sequence
  Description of Artificial Sequence: Synthetic oligonucleotide
cctacgggaggcatcaggcagatctcgataattgccgagggaccaagggatagtcagtcagccggattagataccctagtagtc

SEQ ID NO: 696 - DNA, 84 bp, Artificial Sequence
  Description of Artificial Sequence: Synthetic oligonucleotide
cctacgggaggcatcaggcagatctcgggcatgttatcggtattggtcagaagtcagtcagccggattagataccctagtagtc

SEQ ID NO: 697 - DNA, 84 bp, Artificial Sequence
  Description of Artificial Sequence: Synthetic oligonucleotide
cctacgggaggcatcaggcagatctcgaggcacagtaggagaaccgtcataagtcagtcagccggattagataccctagtagtc

SEQ ID NO: 698 - DNA, 84 bp, Artificial Sequence
  Description of Artificial Sequence: Synthetic oligonucleotide
cctacgggaggcatcaggcagatctcgctacttacatccaactggaaccctagtcagtcagccggattagataccctagtagtc

SEQ ID NO: 699 - DNA, 84 bp, Artificial Sequence
  Description of Artificial Sequence: Synthetic oligonucleotide
cctacgggaggcatcaggcagatctcgctcttctgatcaatactcggctgcagtcagtcagccggattagataccctagtagtc

SEQ ID NO: 700 - DNA, 84 bp, Artificial Sequence
  Description of Artificial Sequence: Synthetic oligonucleotide
cctacgggaggcatcaggcagatctcgatgctaaccacgacgcttaacgacagtcagtcagccggattagataccctagtagtc

SEQ ID NO: 701 - DNA, 84 bp, Artificial Sequence
  Description of Artificial Sequence: Synthetic oligonucleotide
cctacgggaggcatcaggcagatctcgaccaatctcggcagcttaccgaccagtcagtcagccggattagataccctagtagtc

SEQ ID NO: 702 - DNA, 84 bp, Artificial Sequence
  Description of Artificial Sequence: Synthetic oligonucleotide
cctacgggaggcatcaggcagatctcgtatccaagcgcaagggctatagttagtcagtcagccggattagataccctagtagtc

SEQ ID NO: 703 - DNA, 84 bp, Artificial Sequence
  Description of Artificial Sequence: Synthetic oligonucleotide
cctacgggaggcatcaggcagatctcggtactgaagatctgtctcgcaagcagtcagtcagccggattagataccctagtagtc

SEQ ID NO: 704 - DNA, 84 bp, Artificial Sequence
  Description of Artificial Sequence: Synthetic oligonucleotide
cctacgggaggcatcaggcagatctcgtcgccgtgtacacagccgcatatcagtcagtcagccggattagataccctagtagtc

SEQ ID NO: 705 - DNA, 84 bp, Artificial Sequence
  Description of Artificial Sequence: Synthetic oligonucleotide
cctacgggaggcatcaggcagatctcgaactgcgatatggatacgttcgcaagtcagtcagccggattagataccctagtagtc

SEQ ID NO: 706 - DNA, 84 bp, Artificial Sequence
  Description of Artificial Sequence: Synthetic oligonucleotide
cctacgggaggcatcaggcagatctcgcttccaactcatccaagattcgccagtcagtcagccggattagataccctagtagtc

SEQ ID NO: 707 - DNA, 84 bp, Artificial Sequence
  Description of Artificial Sequence: Synthetic oligonucleotide
cctacgggaggcatcaggcagatctcggagatcgcctatgaggctgatttaagtcagtcagccggattagataccctagtagtc

SEQ ID NO: 708 - DNA, 84 bp, Artificial Sequence
  Description of Artificial Sequence: Synthetic oligonucleotide
cctacgggaggcatcaggcagatctcgtgtacatcgccggagttagcatcaagtcagtcagccggattagataccctagtagtc

SEQ ID NO: 709 - DNA, 84 bp, Artificial Sequence
  Description of Artificial Sequence: Synthetic oligonucleotide
cctacgggaggcatcaggcagatctcgtgttaagcagcatgtagtataggcagtcagtcagccggattagataccctagtagtc

SEQ ID NO: 710 - DNA, 84 bp, Artificial Sequence
  Description of Artificial Sequence: Synthetic oligonucleotide
cctacgggaggcatcaggcagatctcgacggcgttatgtctcacgcaatgcagtcagtcagccggattagataccctagtagtc

SEQ ID NO: 711 - DNA, 84 bp, Artificial Sequence
  Description of Artificial Sequence: Synthetic oligonucleotide
cctacgggaggcatcaggcagatctcgactttgctttgcgtcccgtgaaatagtcagtcagccggattagataccctagtagtc

SEQ ID NO: 712 - DNA, 84 bp, Artificial Sequence
  Description of Artificial Sequence: Synthetic oligonucleotide
cctacgggaggcatcaggcagatctcgcaaagcggtattggacagtgtattagtcagtcagccggattagataccctagtagtc

SEQ ID NO: 713 - DNA, 84 bp, Artificial Sequence
  Description of Artificial Sequence: Synthetic oligonucleotide
cctacgggaggcatcaggcagatctcgcgaaactacgtaacacgactatagagtcagtcagccggattagataccctagtagtc

SEQ ID NO: 714 - DNA, 84 bp, Artificial Sequence
  Description of Artificial Sequence: Synthetic oligonucleotide
cctacgggaggcatcaggcagatctcggaggaccagcaagtgtaggtgcttagtcagtcagccggattagataccctagtagtc

SEQ ID NO: 715 - DNA, 84 bp, Artificial Sequence
  Description of Artificial Sequence: Synthetic oligonucleotide
cctacgggaggcatcaggcagatctcgaatagcatgtcgtgaactagcgtcagtcagtcagccggattagataccctagtagtc

SEQ ID NO: 716 - DNA, 84 bp, Artificial Sequence
  Description of Artificial Sequence: Synthetic oligonucleotide
cctacgggaggcatcaggcagatctcgcggagtaatccttccgagtcaccaagtcagtcagccggattagataccctagtagtc

SEQ ID NO: 717 - DNA, 84 bp, Artificial Sequence
  Description of Artificial Sequence: Synthetic oligonucleotide
cctacgggaggcatcaggcagatctcgctgtgtccatggtcctctttggtcagtcagtcagccggattagataccctagtagtc

SEQ ID NO: 718 - DNA, 84 bp, Artificial Sequence
  Description of Artificial Sequence: Synthetic oligonucleotide
cctacgggaggcatcaggcagatctcgcttcgcggatgttccaccctctatagtcagtcagccggattagataccctagtagtc

SEQ ID NO: 719 - DNA, 84 bp, Artificial Sequence
  Description of Artificial Sequence: Synthetic oligonucleotide
cctacgggaggcatcaggcagatctcgataggctgtagttcgtgacgctaaagtcagtcagccggattagataccctagtagtc

SEQ ID NO: 720 - DNA, 84 bp, Artificial Sequence
  Description of Artificial Sequence: Synthetic oligonucleotide
cctacgggaggcatcaggcagatctcgtgtgtagccatgacggctagttccagtcagtcagccggattagataccctagtagtc

SEQ ID NO: 721 - DNA, 84 bp, Artificial Sequence
  Description of Artificial Sequence: Synthetic oligonucleotide
cctacgggaggcatcaggcagatctcgaagggcgctgaagcactggcatatagtcagtcagccggattagataccctagtagtc

SEQ ID NO: 722 - DNA, 84 bp, Artificial Sequence
  Description of Artificial Sequence: Synthetic oligonucleotide
cctacgggaggcatcaggcagatctcggtttccgtggtgggcattagttgaagtcagtcagccggattagataccctagtagtc

SEQ ID NO: 723 - DNA, 84 bp, Artificial Sequence
  Description of Artificial Sequence: Synthetic oligonucleotide
cctacgggaggcatcaggcagatctcgaggaaccagacgcggtagttgatcagtcagtcagccggattagataccctagtagtc

SEQ ID NO: 724 - DNA, 84 bp, Artificial Sequence
  Description of Artificial Sequence: Synthetic oligonucleotide
cctacgggaggcatcaggcagatctcgtaatgcccaggttgaaagcggcgaagtcagtcagccggattagataccctagtagtc

SEQ ID NO: 725 - DNA, 84 bp, Artificial Sequence
  Description of Artificial Sequence: Synthetic oligonucleotide
cctacgggaggcatcaggcagatctcgtatgaacgtccgggttacggttacagtcagtcagccggattagataccctagtagtc

SEQ ID NO: 726 - DNA, 84 bp, Artificial Sequence
  Description of Artificial Sequence: Synthetic oligonucleotide
cctacgggaggcatcaggcagatctcgccacattgggtcacatcaggtcacagtcagtcagccggattagataccctagtagtc

SEQ ID NO: 727 - DNA, 84 bp, Artificial Sequence
  Description of Artificial Sequence: Synthetic oligonucleotide
cctacgggaggcatcaggcagatctcgtcagtcagatgagttgatacgatgagtcagtcagccggattagataccctagtagtc

SEQ ID NO: 728 - DNA, 84 bp, Artificial Sequence
  Description of Artificial Sequence: Synthetic oligonucleotide
cctacgggaggcatcaggcagatctcgaagtcacacacacagacacttccgagtcagtcagccggattagataccctagtagtc

SEQ ID NO: 729 - DNA, 84 bp, Artificial Sequence
  Description of Artificial Sequence: Synthetic oligonucleotide
cctacgggaggcatcaggcagatctcggctgtgattcgatcaccatccgagagtcagtcagccggattagataccctagtagtc

SEQ ID NO: 730 - DNA, 84 bp, Artificial Sequence
  Description of Artificial Sequence: Synthetic oligonucleotide
cctacgggaggcatcaggcagatctcgctagctatggacacccaccactagagtcagtcagccggattagataccctagtagtc

SEQ ID NO: 731 - DNA, 84 bp, Artificial Sequence
  Description of Artificial Sequence: Synthetic oligonucleotide
cctacgggaggcatcaggcagatctcgcttgacgaggttcagaaggtgtggagtcagtcagccggattagataccctagtagtc

SEQ ID NO: 732 - DNA, 84 bp, Artificial Sequence
  Description of Artificial Sequence: Synthetic oligonucleotide
cctacgggaggcatcaggcagatctcgacctgggaatatgaagcttgaatcagtcagtcagccggattagataccctagtagtc

SEQ ID NO: 733 - DNA, 84 bp, Artificial Sequence
  Description of Artificial Sequence: Synthetic oligonucleotide
cctacgggaggcatcaggcagatctcgctctgcctaattactaggatcagtagtcagtcagccggattagataccctagtagtc

SEQ ID NO: 734 - DNA, 84 bp, Artificial Sequence
  Description of Artificial Sequence: Synthetic oligonucleotide
cctacgggaggcatcaggcagatctcgatatgacccagcgctccttagaagagtcagtcagccggattagataccctagtagtc

SEQ ID NO: 735 - DNA, 84 bp, Artificial Sequence
  Description of Artificial Sequence: Synthetic oligonucleotide
cctacgggaggcatcaggcagatctcgctctattccacctcccattcccatagtcagtcagccggattagataccctagtagtc

SEQ ID NO: 736 - DNA, 84 bp, Artificial Sequence
  Description of Artificial Sequence: Synthetic oligonucleotide
cctacgggaggcatcaggcagatctcgattgagtgagtctggcgtcattcgagtcagtcagccggattagataccctagtagtc

SEQ ID NO: 737 - DNA, 84 bp, Artificial Sequence
  Description of Artificial Sequence: Synthetic oligonucleotide
cctacgggaggcatcaggcagatctcgttatggtacggaaatcctcggagtagtcagtcagccggattagataccctagtagtc

SEQ ID NO: 738 - DNA, 84 bp, Artificial Sequence
  Description of Artificial Sequence: Synthetic oligonucleotide
cctacgggaggcatcaggcagatctcggctagttatggactggacgcattaagtcagtcagccggattagataccctagtagtc

SEQ ID NO: 739 - DNA, 84 bp, Artificial Sequence
  Description of Artificial Sequence: Synthetic oligonucleotide
cctacgggaggcatcaggcagatctcgcagattaaccagaccgattaggtaagtcagtcagccggattagataccctagtagtc

SEQ ID NO: 740 - DNA, 84 bp, Artificial Sequence
  Description of Artificial Sequence: Synthetic oligonucleotide
cctacgggaggcatcaggcagatctcgggctgcatactcatgtgctgctcgagtcagtcagccggattagataccctagtagtc

SEQ ID NO: 741 - DNA, 84 bp, Artificial Sequence
  Description of Artificial Sequence: Synthetic oligonucleotide
cctacgggaggcatcaggcagatctcgttggtaaagtgctacgtacgaaacagtcagtcagccggattagataccctagtagtc

SEQ ID NO: 742 - DNA, 84 bp, Artificial Sequence
  Description of Artificial Sequence: Synthetic oligonucleotide
cctacgggaggcatcaggcagatctcgaagtggctatccatcacattctccagtcagtcagccggattagataccctagtagtc

SEQ ID NO: 743 - DNA, 84 bp, Artificial Sequence
  Description of Artificial Sequence: Synthetic oligonucleotide
cctacgggaggcatcaggcagatctcgaaccgatgtaccagcctggtacctagtcagtcagccggattagataccctagtagtc

SEQ ID NO: 744 - DNA, 84 bp, Artificial Sequence
  Description of Artificial Sequence: Synthetic oligonucleotide
cctacgggaggcatcaggcagatctcgtcgattggccgtgctaaagtcgtaagtcagtcagccggattagataccctagtagtc

SEQ ID NO: 745 - DNA, 84 bp, Artificial Sequence
  Description of Artificial Sequence: Synthetic oligonucleotide
cctacgggaggcatcaggcagatctcggcattactggactctcagcgcgtaagtcagtcagccggattagataccctagtagtc

SEQ ID NO: 746 - DNA, 84 bp, Artificial Sequence
  Description of Artificial Sequence: Synthetic oligonucleotide
cctacgggaggcatcaggcagatctcgttgggccacatagaccctagacctagtcagtcagccggattagataccctagtagtc

SEQ ID NO: 747 - DNA, 84 bp, Artificial Sequence
  Description of Artificial Sequence: Synthetic oligonucleotide
cctacgggaggcatcaggcagatctcgcacacaaagtcatattcagcggacagtcagtcagccggattagataccctagtagtc

SEQ ID NO: 748 - DNA, 84 bp, Artificial Sequence
  Description of Artificial Sequence: Synthetic oligonucleotide
cctacgggaggcatcaggcagatctcggccaaggatagggttccggattagagtcagtcagccggattagataccctagtagtc

SEQ ID NO: 749 - DNA, 84 bp, Artificial Sequence
  Description of Artificial Sequence: Synthetic oligonucleotide
cctacgggaggcatcaggcagatctcgcgccacgtgtatgcgtgtaattagagtcagtcagccggattagataccctagtagtc

SEQ ID NO: 750 - DNA, 84 bp, Artificial Sequence
  Description of Artificial Sequence: Synthetic oligonucleotide
cctacgggaggcatcaggcagatctcggcaaccgattgtctgtagcttggcagtcagtcagccggattagataccctagtagtc

SEQ ID NO: 751 - DNA, 84 bp, Artificial Sequence
  Description of Artificial Sequence: Synthetic oligonucleotide
cctacgggaggcatcaggcagatctcgcatgtgcttaggatgcctcgtaagagtcagtcagccggattagataccctagtagtc

SEQ ID NO: 752 - DNA, 84 bp, Artificial Sequence
  Description of Artificial Sequence: Synthetic oligonucleotide
cctacgggaggcatcaggcagatctcggttcctccattaacctatggtgaaagtcagtcagccggattagataccctagtagtc

SEQ ID NO: 753 - DNA, 84 bp, Artificial Sequence
  Description of Artificial Sequence: Synthetic oligonucleotide
cctacgggaggcatcaggcagatctcgacctgtcctttcctgttacagcgaagtcagtcagccggattagataccctagtagtc

SEQ ID NO: 754 - DNA, 84 bp, Artificial Sequence
  Description of Artificial Sequence: Synthetic oligonucleotide
cctacgggaggcatcaggcagatctcggttcacgcccaacagtcaggccttagtcagtcagccggattagataccctagtagtc

SEQ ID NO: 755 - DNA, 84 bp, Artificial Sequence
  Description of Artificial Sequence: Synthetic oligonucleotide
cctacgggaggcatcaggcagatctcgcgatcgaacactactgagctgcatagtcagtcagccggattagataccctagtagtc

SEQ ID NO: 756 - DNA, 84 bp, Artificial Sequence
  Description of Artificial Sequence: Synthetic oligonucleotide
cctacgggaggcatcaggcagatctcgcatgccaacatgacgaagtctaccagtcagtcagccggattagataccctagtagtc

SEQ ID NO: 757 - DNA, 84 bp, Artificial Sequence
  Description of Artificial Sequence: Synthetic oligonucleotide
cctacgggaggcatcaggcagatctcggagtacagtctaaccgtctttctcagtcagtcagccggattagataccctagtagtc

SEQ ID NO: 758 - DNA, 84 bp, Artificial Sequence
  Description of Artificial Sequence: Synthetic oligonucleotide
cctacgggaggcatcaggcagatctcgcctacatgagacagtctgtctgcgagtcagtcagccggattagataccctagtagtc

SEQ ID NO: 759 - DNA, 84 bp, Artificial Sequence
  Description of Artificial Sequence: Synthetic oligonucleotide
cctacgggaggcatcaggcagatctcgtccgtggtatagccgcactcaagtagtcagtcagccggattagataccctagtagtc

SEQ ID NO: 760 - DNA, 84 bp, Artificial Sequence
  Description of Artificial Sequence: Synthetic oligonucleotide
cctacgggaggcatcaggcagatctcgtctacggcacgttgtggaaactccagtcagtcagccggattagataccctagtagtc

SEQ ID NO: 761 - DNA, 84 bp, Artificial Sequence
  Description of Artificial Sequence: Synthetic oligonucleotide
cctacgggaggcatcaggcagatctcgatgctgcaacacttaggcaggttcagtcagtcagccggattagataccctagtagtc

SEQ ID NO: 762 - DNA, 84 bp, Artificial Sequence
  Description of Artificial Sequence: Synthetic oligonucleotide
cctacgggaggcatcaggcagatctcgttctcatggaggtaagactactggagtcagtcagccggattagataccctagtagtc

SEQ ID NO: 763 - DNA, 84 bp, Artificial Sequence
  Description of Artificial Sequence: Synthetic oligonucleotide
cctacgggaggcatcaggcagatctcgcatagtgattggcgcgaagtttcaagtcagtcagccggattagataccctagtagtc

SEQ ID NO: 764 - DNA, 84 bp, Artificial Sequence
  Description of Artificial Sequence: Synthetic oligonucleotide
cctacgggaggcatcaggcagatctcggctatcaagacacgatacactgccagtcagtcagccggattagataccctagtagtc

SEQ ID NO: 765 - DNA, 84 bp, Artificial Sequence
  Description of Artificial Sequence: Synthetic oligonucleotide
cctacgggaggcatcaggcagatctcgccgtgacaactcttgaaatcccggagtcagtcagccggattagataccctagtagtc

SEQ ID NO: 766 - DNA, 84 bp, Artificial Sequence
  Description of Artificial Sequence: Synthetic oligonucleotide
cctacgggaggcatcaggcagatctcgcgttccttgttagttagggagcgaagtcagtcagccggattagataccctagtagtc

SEQ ID NO: 767 - DNA, 84 bp, Artificial Sequence
  Description of Artificial Sequence: Synthetic oligonucleotide
cctacgggaggcatcaggcagatctcgggaattatcggtttactgtggccgagtcagtcagccggattagataccctagtagtc

SEQ ID NO: 768 - DNA, 84 bp, Artificial Sequence
  Description of Artificial Sequence: Synthetic oligonucleotide
cctacgggaggcatcaggcagatctcgcatcaagcatagatataaggcccaagtcagtcagccggattagataccctagtagtc

SEQ ID NO: 769 - DNA, 3368 bp, Artificial Sequence
  Description of Artificial Sequence: Synthetic polynucleotide
gtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagctcttatggtttcccaagctgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctgcgatccggatctggatccagatcgggatctggatcaagcttggatcctatctcctttccctacgggaggcatcaggcagatctcgtcccttgtctccacgagactgattagtcagtcagccggattagataccctagtagtcgaaagttgagaccatggaattcgatctggatcttgatccggatcacgatctcgatcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcggtcttatggtttcccaagctggcctcgtgatacgcctatttttataggttaatgtcatgggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtcttgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatgtgaataaattgcagtttcatttgatgctcgatgagtttttctaatcagaattggttaattggtt

SEQ ID NO: 770 - DNA, 3368 bp, Artificial Sequence
  Description of Artificial Sequence: Synthetic polynucleotide
gtaacactggcagagcattacgctgacttgacgggacggcgcaagctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagctcttatggtttcccaagctgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctgcgatccggatctggatccagatcgggatctggatcaagcttggatcctatctcctttccctacgggaggcatcaggcagatctcggctgtacggattatcaccaggtgtagtcagtcagccggattagataccctagtagtcgaaagttgagaccatggaattcgatctggatcttgatccggatcacgatctcgatcaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcggtcttatggtttcccaagctggcctcgtgatacgcctatttttataggttaatgtcatgggggggggggggaaagccacgttgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtcttgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatgtgaataaattgcagtttcatttgatgctcgatgagtttttctaatcagaattggttaattggtt

SEQ ID NO: 771 - DNA, 84 bp, Artificial Sequence; identical to SEQ ID NO: 385
  Description of Artificial Sequence: Synthetic oligonucleotide

SEQ ID NO: 772 - DNA, 84 bp, Artificial Sequence; identical to SEQ ID NO: 386
  Description of Artificial Sequence: Synthetic oligonucleotide

SEQ ID NO: 773 - DNA, 50 bp, Artificial Sequence
  Description of Artificial Sequence: Synthetic primer
  modified_base (42)..(42): a, c, t, g, unknown or other
tcgtcggcagcgtcagatgtgtataagagacagcctacgggnggcwgcag

SEQ ID NO: 774 - DNA, 55 bp, Artificial Sequence
  Description of Artificial Sequence: Synthetic primer
gtctcgtgggctcggagatgtgtataagagacaggactachvgggtatctaatcc

SEQ ID NO: 775 - DNA, 12 bp, Artificial Sequence
  Description of Artificial Sequence: Synthetic oligonucleotide
tggtcaacgata

SEQ ID NO: 776 - DNA, 12 bp, Artificial Sequence
  Description of Artificial Sequence: Synthetic oligonucleotide
catcgcgttgac

SEQ ID NO: 777 - DNA, 12 bp, Artificial Sequence
  Description of Artificial Sequence: Synthetic oligonucleotide
acgtaaccacgt

SEQ ID NO: 778 - DNA, 12 bp, Artificial Sequence
  Description of Artificial Sequence: Synthetic oligonucleotide
cttcttcgccct

SEQ ID NO: 779 - DNA, 12 bp, Artificial Sequence
  Description of Artificial Sequence: Synthetic oligonucleotide
gacggctatgtt

SEQ ID NO: 780 - DNA, 12 bp, Artificial Sequence
  Description of Artificial Sequence: Synthetic oligonucleotide
gtcattgggcta

SEQ ID NO: 781 - DNA, 12 bp, Artificial Sequence
  Description of Artificial Sequence: Synthetic oligonucleotide
atcgcacagtaa

SEQ ID NO: 782 - DNA, 12 bp, Artificial Sequence
  Description of Artificial Sequence: Synthetic oligonucleotide
gcacatagtcgt

SEQ ID NO: 783 - DNA, 12 bp, Artificial Sequence
  Description of Artificial Sequence: Synthetic oligonucleotide
gtcggaaattgt

SEQ ID NO: 784 - DNA, 12 bp, Artificial Sequence
  Description of Artificial Sequence: Synthetic oligonucleotide
caggcataacat

SEQ ID NO: 785 - DNA, 12 bp, Artificial Sequence
  Description of Artificial Sequence: Synthetic oligonucleotide
tctctttcgaca

SEQ ID NO: 786 - DNA, 12 bp, Artificial Sequence
  Description of Artificial Sequence: Synthetic oligonucleotide
agagacgcgtag

SEQ ID NO: 787 - DNA, 12 bp, Artificial Sequence
  Description of Artificial Sequence: Synthetic oligonucleotide
gtcgtgtagcct

SEQ ID NO: 788 - DNA, 12 bp, Artificial Sequence
  Description of Artificial Sequence: Synthetic oligonucleotide
ggcaaatacact

SEQ ID NO: 789 - DNA, 12 bp, Artificial Sequence
  Description of Artificial Sequence: Synthetic oligonucleotide
tctaacgagtgc

SEQ ID NO: 790 - DNA, 12 bp, Artificial Sequence
  Description of Artificial Sequence: Synthetic oligonucleotide
atgtggcgtgtt

SEQ ID NO: 791 - DNA, 12 bp, Artificial Sequence
  Description of Artificial Sequence: Synthetic oligonucleotide
gattaggttccg

SEQ ID NO: 792 - DNA, 12 bp, Artificial Sequence
  Description of Artificial Sequence: Synthetic oligonucleotide
ttaatggatcgg

SEQ ID NO: 793 - DNA, 12 bp, Artificial Sequence
  Description of Artificial Sequence: Synthetic oligonucleotide
agcggaggttag

SEQ ID NO: 794 - DNA, 12 bp, Artificial Sequence
  Description of Artificial Sequence: Synthetic oligonucleotide
gtcatgctccag

SEQ ID NO: 795 - DNA, 12 bp, Artificial Sequence
  Description of Artificial Sequence: Synthetic oligonucleotide
catctgggcaat

SEQ ID NO: 796 - DNA, 12 bp, Artificial Sequence
  Description of Artificial Sequence: Synthetic oligonucleotide
gtgcggttcact

SEQ ID NO: 797 - DNA, 12 bp, Artificial Sequence
  Description of Artificial Sequence: Synthetic oligonucleotide
ctactccacgag

SEQ ID NO: 798 - DNA, 12 bp, Artificial Sequence
  Description of Artificial Sequence: Synthetic oligonucleotide
atattggcagcc

SEQ ID NO: 799 - DNA, 12 bp, Artificial Sequence
  Description of Artificial Sequence: Synthetic oligonucleotide
atcctttggttc

SEQ ID NO: 800 - DNA, 12 bp, Artificial Sequence
  Description of Artificial Sequence: Synthetic oligonucleotide
cctagtaagctg

SEQ ID NO: 801 - DNA, 12 bp, Artificial Sequence
  Description of Artificial Sequence: Synthetic oligonucleotide
tgtccgtggatc

SEQ ID NO: 802 - DNA, 12 bp, Artificial Sequence
  Description of Artificial Sequence: Synthetic oligonucleotide
cctcactagcga

SEQ ID NO: 803 - DNA, 12 bp, Artificial Sequence
  Description of Artificial Sequence: Synthetic oligonucleotide
ggtgcagacaga

SEQ ID NO: 804 - DNA, 12 bp, Artificial Sequence
  Description of Artificial Sequence: Synthetic oligonucleotide
tcgcatggatac

SEQ ID NO: 805 - DNA, 12 bp, Artificial Sequence
  Description of Artificial Sequence: Synthetic oligonucleotide
tacagcgcatac

SEQ ID NO: 806 - DNA, 12 bp, Artificial Sequence
  Description of Artificial Sequence: Synthetic oligonucleotide
ttaccgacgagt

SEQ ID NO: 807 - DNA, 12 bp, Artificial Sequence
  Description of Artificial Sequence: Synthetic oligonucleotide
actcggccaact

SEQ ID NO: 808 - DNA, 12 bp, Artificial Sequence
  Description of Artificial Sequence: Synthetic oligonucleotide
agctgatagttg

SEQ ID NO: 809 - DNA, 12 bp, Artificial Sequence
  Description of Artificial Sequence: Synthetic oligonucleotide
ccgtaccgtatg

SEQ ID NO: 810 - DNA, 12 bp, Artificial Sequence
  Description of Artificial Sequence: Synthetic oligonucleotide
caacaatgccaa

SEQ ID NO: 811 - DNA, 12 bp, Artificial Sequence
  Description of Artificial Sequence: Synthetic oligonucleotide
accggtatgtac

SEQ ID NO: 812 - DNA, 12 bp, Artificial Sequence
  Description of Artificial Sequence: Synthetic oligonucleotide
gcttagatgtag

SEQ ID NO: 813 - DNA, 12 bp, Artificial Sequence
  Description of Artificial Sequence: Synthetic oligonucleotide
gttggttggcat

SEQ ID NO: 814 - DNA, 12 bp, Artificial Sequence
  Description of Artificial Sequence: Synthetic oligonucleotide
gctctagtaacg

SEQ ID NO: 815 - DNA, 12 bp, Artificial Sequence
  Description of Artificial Sequence: Synthetic oligonucleotide
atgtccgaccaa

SEQ ID NO: 816 - DNA, 12 bp, Artificial Sequence
  Description of Artificial Sequence: Synthetic oligonucleotide
gcccgacatata

SEQ ID NO: 817 - DNA, 12 bp, Artificial Sequence
  Description of Artificial Sequence: Synthetic oligonucleotide
aattgtgtcgga

SEQ ID NO: 818 - DNA, 12 bp, Artificial Sequence
  Description of Artificial Sequence: Synthetic oligonucleotide
aagacgtagcgg

SEQ ID NO: 819 - DNA, 12 bp, Artificial Sequence
  Description of Artificial Sequence: Synthetic oligonucleotide
ttccacacgtgg

SEQ ID NO: 820 - DNA, 12 bp, Artificial Sequence
  Description of Artificial Sequence: Synthetic oligonucleotide
tggtcctacaag

SEQ ID NO: 821 - DNA, 12 bp, Artificial Sequence
  Description of Artificial Sequence: Synthetic oligonucleotide
agatgggactgg

SEQ ID NO: 822 - DNA, 12 bp, Artificial Sequence
  Description of Artificial Sequence: Synthetic oligonucleotide
gattgaacgcta

SEQ ID NO: 823 - DNA, 12 bp, Artificial Sequence
  Description of Artificial Sequence: Synthetic oligonucleotide
tgcatacactgg

SEQ ID NO: 824 - DNA, 12 bp, Artificial Sequence
  Description of Artificial Sequence: Synthetic oligonucleotide
ttaccttacacc

SEQ ID NO: 825 - DNA, 12 bp, Artificial Sequence
  Description of Artificial Sequence: Synthetic oligonucleotide
aacccagatgat

SEQ ID NO: 826 - DNA, 12 bp, Artificial Sequence
  Description of Artificial Sequence: Synthetic oligonucleotide
cgctatccagac

SEQ ID NO: 827 - DNA, 12 bp, Artificial Sequence
  Description of Artificial Sequence: Synthetic oligonucleotide
gtgcccacttga

SEQ ID NO: 828 - DNA, 12 bp, Artificial Sequence
  Description of Artificial Sequence: Synthetic oligonucleotide
agtattcgcgca

SEQ ID NO: 829 - DNA, 12 bp, Artificial Sequence
  Description of Artificial Sequence: Synthetic oligonucleotide
agtcgaacgagg

SEQ ID NO: 830 - DNA, 12 bp, Artificial Sequence
  Description of Artificial Sequence: Synthetic oligonucleotide
tgactaatggcc

SEQ ID NO: 831 - DNA, 12 bp, Artificial Sequence
  Description of Artificial Sequence: Synthetic oligonucleotide
gtagtgtcaaca

SEQ ID NO: 832 - DNA, 12 bp, Artificial Sequence
  Description of Artificial Sequence: Synthetic oligonucleotide
gcttacgtaggt

SEQ ID NO: 833 - DNA, 12 bp, Artificial Sequence
  Description of Artificial Sequence: Synthetic oligonucleotide
accgaacaatcc

SEQ ID NO: 834 - DNA, 12 bp, Artificial Sequence
  Description of Artificial Sequence: Synthetic oligonucleotide
tgccaacaacaa

SEQ ID NO: 835 - DNA, 12 bp, Artificial Sequence
  Description of Artificial Sequence: Synthetic oligonucleotide
accagtgactca

SEQ ID NO: 836 - DNA, 12 bp, Artificial Sequence
  Description of Artificial Sequence: Synthetic oligonucleotide
ctctctcacttg

SEQ ID NO: 837 - DNA, 12 bp, Artificial Sequence
  Description of Artificial Sequence: Synthetic oligonucleotide
tggagaggagat

SEQ ID NO: 838 - DNA, 12 bp, Artificial Sequence
  Description of Artificial Sequence: Synthetic oligonucleotide
agttggttacga

SEQ ID NO: 839 - DNA, 12 bp, Artificial Sequence
  Description of Artificial Sequence: Synthetic oligonucleotide
gtctaccacgca

SEQ ID NO: 840 - DNA, 12 bp, Artificial Sequence
  Description of Artificial Sequence: Synthetic oligonucleotide
ctaaagtagcac

SEQ ID NO: 841 - DNA, 12 bp, Artificial Sequence
  Description of Artificial Sequence: Synthetic oligonucleotide
gaataccaagtc

SEQ ID NO: 842 - DNA, 12 bp, Artificial Sequence
  Description of Artificial Sequence: Synthetic oligonucleotide
attgcaagcaac

SEQ ID NO: 843 - DNA, 12 bp, Artificial Sequence
  Description of Artificial Sequence: Synthetic oligonucleotide
cgtataaatgcg

SEQ ID NO: 844 - DNA, 12 bp, Artificial Sequence
  Description of Artificial Sequence: Synthetic oligonucleotide
ctctacgaacag

SEQ ID NO: 845 - DNA, 12 bp, Artificial Sequence
  Description of Artificial Sequence: Synthetic oligonucleotide
tcgcgtccagta

SEQ ID NO: 846 - DNA, 12 bp, Artificial Sequence
  Description of Artificial Sequence: Synthetic oligonucleotide
agtgctaggtta

SEQ ID NO: 847 - DNA, 12 bp, Artificial Sequence
  Description of Artificial Sequence: Synthetic oligonucleotide
gtagatcgtgta

SEQ ID NO: 848 - DNA, 12 bp, Artificial Sequence
  Description of Artificial Sequence: Synthetic oligonucleotide
cacgtgacatgt

SEQ ID NO: 849 - DNA, 12 bp, Artificial Sequence
  Description of Artificial Sequence: Synthetic oligonucleotide
aatacagacctg

SEQ ID NO: 850 - DNA, 12 bp, Artificial Sequence
  Description of Artificial Sequence: Synthetic oligonucleotide
cctgtgttggtg

SEQ ID NO: 851 - DNA, 12 bp, Artificial Sequence
  Description of Artificial Sequence: Synthetic oligonucleotide
gcctgattaagc

SEQ ID NO: 852 - DNA, 12 bp, Artificial Sequence
  Description of Artificial Sequence: Synthetic oligonucleotide
cggaaactccat

SEQ ID NO: 853 - DNA, 12 bp, Artificial Sequence
  Description of Artificial Sequence: Synthetic oligonucleotide
taacgtgtgtgc

SEQ ID NO: 854 - DNA, 12 bp, Artificial Sequence
  Description of Artificial Sequence: Synthetic oligonucleotide
cacagttgaagt

SEQ ID NO: 855 - DNA, 12 bp, Artificial Sequence
  Description of Artificial Sequence: Synthetic oligonucleotide
gactcaaccagt

SEQ ID NO: 856 - DNA, 12 bp, Artificial Sequence
  Description of Artificial Sequence: Synthetic oligonucleotide
gatgggaggact

SEQ ID NO: 857 - DNA, 12 bp, Artificial Sequence
  Description of Artificial Sequence: Synthetic oligonucleotide
acgtattcgaag

SEQ ID NO: 858 - DNA, 12 bp, Artificial Sequence
  Description of Artificial Sequence: Synthetic oligonucleotide
aggaaagccaga

SEQ ID NO: 859 - DNA, 12 bp, Artificial Sequence
  Description of Artificial Sequence: Synthetic oligonucleotide
cattatggcgtg

SEQ ID NO: 860 - DNA, 12 bp, Artificial Sequence
  Description of Artificial Sequence: Synthetic oligonucleotide
ctaggatcactg

SEQ ID NO: 861 - DNA, 12 bp, Artificial Sequence
  Description of Artificial Sequence: Synthetic oligonucleotide
ggaagaagtagc

SEQ ID NO: 862 - DNA, 12 bp, Artificial Sequence
  Description of Artificial Sequence: Synthetic oligonucleotide
cagaatcgctca

SEQ ID NO: 863 - DNA, 12 bp, Artificial Sequence
  Description of Artificial Sequence: Synthetic oligonucleotide
cggctactatgc

SEQ ID NO: 864 - DNA, 12 bp, Artificial Sequence
  Description of Artificial Sequence: Synthetic oligonucleotide
gtctgacggtct

SEQ ID NO: 865 - DNA, 12 bp, Artificial Sequence
  Description of Artificial Sequence: Synthetic oligonucleotide
ccaatacgcctg

SEQ ID NO: 866 - DNA, 12 bp, Artificial Sequence
  Description of Artificial Sequence: Synthetic oligonucleotide
gatgacccaaat

SEQ ID NO: 867 - DNA, 12 bp, Artificial Sequence
  Description of Artificial Sequence: Synthetic oligonucleotide
atcgatccacag

SEQ ID NO: 868 - DNA, 12 bp, Artificial Sequence
  Description of Artificial Sequence: Synthetic oligonucleotide
tggcactggtta

SEQ ID NO: 869 - DNA, 12 bp, Artificial Sequence
  Description of Artificial Sequence: Synthetic oligonucleotide
agttcggcattg

SEQ ID NO: 870 - DNA, 12 bp, Artificial Sequence
  Description of Artificial Sequence: Synthetic oligonucleotide
gaaaccaagctt

SEQ ID NO: 871 - DNA, 12 bp, Artificial Sequence
  Description of Artificial Sequence: Synthetic oligonucleotide
gatctgcgatcc

SEQ ID NO: 872 - DNA, 12 bp, Artificial Sequence
  Description of Artificial Sequence: Synthetic oligonucleotide
accggagtagga

SEQ ID NO: 873 - DNA, 12 bp, Artificial Sequence
  Description of Artificial Sequence: Synthetic oligonucleotide
acaccgcacaat

SEQ ID NO: 874 - DNA, 12 bp, Artificial Sequence
  Description of Artificial Sequence: Synthetic oligonucleotide
ggcagtgttaat

SEQ ID NO: 875 - DNA, 12 bp, Artificial Sequence
  Description of Artificial Sequence: Synthetic oligonucleotide
ttgggagcgaag

SEQ ID NO: 876 - DNA, 12 bp, Artificial Sequence
  Description of Artificial Sequence: Synthetic oligonucleotide
tcatcacgggct

SEQ ID NO: 877 - DNA, 12 bp, Artificial Sequence
  Description of Artificial Sequence: Synthetic oligonucleotide
cagctcatcagc

SEQ ID NO: 878 - DNA, 12 bp, Artificial Sequence
  Description of Artificial Sequence: Synthetic oligonucleotide
tgaggactacct

SEQ ID NO: 879 - DNA, 12 bp, Artificial Sequence
  Description of Artificial Sequence: Synthetic oligonucleotide
gtctcctccctt

SEQ ID NO: 880 - DNA, 12 bp, Artificial Sequence
  Description of Artificial Sequence: Synthetic oligonucleotide
aacccgtcgtca

SEQ ID NO: 881 - DNA, 12 bp, Artificial Sequence
  Description of Artificial Sequence: Synthetic oligonucleotide
tgttcgcccaga

SEQ ID NO: 882 - DNA, 12 bp, Artificial Sequence
  Description of Artificial Sequence: Synthetic oligonucleotide
tgttctgagacg

SEQ ID NO: 883 - DNA, 12 bp, Artificial Sequence
  Description of Artificial Sequence: Synthetic oligonucleotide
caaacaacagct

SEQ ID NO: 884 - DNA, 12 bp, Artificial Sequence
  Description of Artificial Sequence: Synthetic oligonucleotide
caatcggcttgc

SEQ ID NO: 885 - DNA, 12 bp, Artificial Sequence
  Description of Artificial Sequence: Synthetic oligonucleotide
gtagcactcatg

SEQ ID NO: 886 - DNA, 12 bp, Artificial Sequence
  Description of Artificial Sequence: Synthetic oligonucleotide
agaggagtcgac

SEQ ID NO: 887 - DNA, 12 bp, Artificial Sequence
  Description of Artificial Sequence: Synthetic oligonucleotide
cgcgtatctcag

SEQ ID NO: 888 - DNA, 12 bp, Artificial Sequence
  Description of Artificial Sequence: Synthetic oligonucleotide
atagcaccagat

SEQ ID NO: 889 - DNA, 12 bp, Artificial Sequence
  Description of Artificial Sequence: Synthetic oligonucleotide
gcaacaccatcc

SEQ ID NO: 890 - DNA, 12 bp, Artificial Sequence
  Description of Artificial Sequence: Synthetic oligonucleotide
aacactcgatcg

SEQ ID NO: 891 - DNA, 12 bp, Artificial Sequence
  Description of Artificial Sequence: Synthetic oligonucleotide
cacctgtagtag

SEQ ID NO: 892 - DNA, 12 bp, Artificial Sequence
  Description of Artificial Sequence: Synthetic oligonucleotide
taagtcggccta

SEQ ID NO: 893 - DNA, 12 bp, Artificial Sequence
  Description of Artificial Sequence: Synthetic oligonucleotide
cgaaagcattcc

SEQ ID NO: 894 - DNA, 12 bp, Artificial Sequence
  Description of Artificial Sequence: Synthetic oligonucleotide
atctcgctgggt

SEQ ID NO: 895 - DNA, 12 bp, Artificial Sequence
  Description of Artificial Sequence: Synthetic oligonucleotide
gcgatatatcgc

SEQ ID NO: 896 - DNA, 12 bp, Artificial Sequence
  Description of Artificial Sequence: Synthetic oligonucleotide
tgaccggctgtt

SEQ ID NO: 897 - DNA, 12 bp, Artificial Sequence
  Description of Artificial Sequence: Synthetic oligonucleotide
cacgagctactc

SEQ ID NO: 898 - DNA, 12 bp, Artificial Sequence
  Description of Artificial Sequence: Synthetic oligonucleotide
cagggtagggta

SEQ ID NO: 899 - DNA, 12 bp, Artificial Sequence
  Description of Artificial Sequence: Synthetic oligonucleotide
ccggacaagaag

SEQ ID NO: 900 - DNA, 12 bp, Artificial Sequence
  Description of Artificial Sequence: Synthetic oligonucleotide
gcgcgtgtatct

SEQ ID NO: 901 - DNA, 12 bp, Artificial Sequence
  Description of Artificial Sequence: Synthetic oligonucleotide
cgagcaatccta

SEQ ID NO: 902 - DNA, 12 bp, Artificial Sequence
  Description of Artificial Sequence: Synthetic oligonucleotide
ggaggagcaata

SEQ ID NO: 903 - DNA, 12 bp, Artificial Sequence
  Description of Artificial Sequence: Synthetic oligonucleotide
tctcgataagcg

SEQ ID NO: 904 - DNA, 12 bp, Artificial Sequence
  Description of Artificial Sequence: Synthetic oligonucleotide
catgggtgttac

SEQ ID NO: 905 - DNA, 12 bp, Artificial Sequence
  Description of Artificial Sequence: Synthetic oligonucleotide
cgatccgatctg

SEQ ID NO: 906 - DNA, 12 bp, Artificial Sequence
  Description of Artificial Sequence: Synthetic oligonucleotide
aacgcgaaattc

SEQ ID NO: 907 - DNA, 12 bp, Artificial Sequence
  Description of Artificial Sequence: Synthetic oligonucleotide
agtcgtgcacat

SEQ ID NO: 908 - DNA, 12 bp, Artificial Sequence
  Description of Artificial Sequence: Synthetic oligonucleotide
agcgacgaagac

SEQ ID NO: 909 - DNA, 12 bp, Artificial Sequence
  Description of Artificial Sequence: Synthetic oligonucleotide
tagacaccgtgt

SEQ ID NO: 910 - DNA, 12 bp, Artificial Sequence
  Description of Artificial Sequence: Synthetic oligonucleotide
gatgcctaatga

SEQ ID NO: 911 - DNA, 12 bp, Artificial Sequence
  Description of Artificial Sequence: Synthetic oligonucleotide
tgcatcgcgtca

SEQ ID NO: 912 - DNA, 12 bp, Artificial Sequence
  Description of Artificial Sequence: Synthetic oligonucleotide
atctggacgatc

SEQ ID NO: 913 - DNA, 12 bp, Artificial Sequence
  Description of Artificial Sequence: Synthetic oligonucleotide
gtatctgcgcgt

SEQ ID NO: 914 - DNA, 12 bp, Artificial Sequence
  Description of Artificial Sequence: Synthetic oligonucleotide
cttccctaactc

SEQ ID NO: 915 - DNA, 12 bp, Artificial Sequence
  Description of Artificial Sequence: Synthetic oligonucleotide
agacaagcttcc

SEQ ID NO: 916 - DNA, 12 bp, Artificial Sequence
  Description of Artificial Sequence: Synthetic oligonucleotide
ttatcgggcatg

SEQ ID NO: 917 - DNA, 12 bp, Artificial Sequence
  Description of Artificial Sequence: Synthetic oligonucleotide
atggacctagct

SEQ ID NO: 918 - DNA, 12 bp, Artificial Sequence
  Description of Artificial Sequence: Synthetic oligonucleotide
ccagctggactt

SEQ ID NO: 919 - DNA, 12 bp, Artificial Sequence
  Description of Artificial Sequence: Synthetic oligonucleotide
cgagggaaagtc

SEQ ID NO: 920 - DNA, 12 bp, Artificial Sequence
  Description of Artificial Sequence: Synthetic oligonucleotide
tggaagaacggc

SEQ ID NO: 921 - DNA, 12 bp, Artificial Sequence
  Description of Artificial Sequence: Synthetic oligonucleotide
tccgcaacctga

SEQ ID NO: 922 - DNA, 12 bp, Artificial Sequence
  Description of Artificial Sequence: Synthetic oligonucleotide
tggacataaacc

SEQ ID NO: 923 - DNA, 12 bp, Artificial Sequence
  Description of Artificial Sequence: Synthetic oligonucleotide
aggaatactcac

SEQ ID NO: 924 - DNA, 12 bp, Artificial Sequence
  Description of Artificial Sequence: Synthetic oligonucleotide
ctctaacctcta

SEQ ID NO: 925 - DNA, 12 bp, Artificial Sequence
  Description of Artificial Sequence: Synthetic oligonucleotide
caaattcgggat

SEQ ID NO: 926 - DNA, 12 bp, Artificial Sequence
  Description of Artificial Sequence: Synthetic oligonucleotide
gctagacactac

SEQ ID NO: 927 - DNA, 12 bp, Artificial Sequence
  Description of Artificial Sequence: Synthetic oligonucleotide
tcacttggtgcg

SEQ ID NO: 928 - DNA, 12 bp, Artificial Sequence
  Description of Artificial Sequence: Synthetic oligonucleotide
tgacctcaagac

SEQ ID NO: 929 - DNA, 12 bp, Artificial Sequence
  Description of Artificial Sequence: Synthetic oligonucleotide
ctaccttgagga

SEQ ID NO: 930 - DNA, 12 bp, Artificial Sequence
  Description of Artificial Sequence: Synthetic oligonucleotide
caaccgagatta

SEQ ID NO: 931 - DNA, 12 bp, Artificial Sequence
  Description of Artificial Sequence: Synthetic oligonucleotide
agattgaccaac

SEQ ID NO: 932 - DNA, 12 bp, Artificial Sequence
  Description of Artificial Sequence: Synthetic oligonucleotide
ttggattgaacg

SEQ ID NO: 933 - DNA, 12 bp, Artificial Sequence
  Description of Artificial Sequence: Synthetic oligonucleotide
ttatgtacggcg

SEQ ID NO: 934 - DNA, 12 bp, Artificial Sequence
  Description of Artificial Sequence: Synthetic oligonucleotide
gccaaatcgctc

SEQ ID NO: 935 - DNA, 12 bp, Artificial Sequence
  Description of Artificial Sequence: Synthetic oligonucleotide
cgtgttatgtgg

SEQ ID NO: 936 - DNA, 12 bp, Artificial Sequence
  Description of Artificial Sequence: Synthetic oligonucleotide
gattcgagtgtc

SEQ ID NO: 937 - DNA, 12 bp, Artificial Sequence
  Description of Artificial Sequence: Synthetic oligonucleotide
agttacgagcta

SEQ ID NO: 938 - DNA, 12 bp, Artificial Sequence
  Description of Artificial Sequence: Synthetic oligonucleotide
gatataccagtg

SEQ ID NO: 939 - DNA, 12 bp, Artificial Sequence
  Description of Artificial Sequence: Synthetic oligonucleotide
ttggacgtccac

SEQ ID NO: 940 - DNA, 12 bp, Artificial Sequence
  Description of Artificial Sequence: Synthetic oligonucleotide
tcaaagctcaag

SEQ ID NO: 941 - DNA, 12 bp, Artificial Sequence
  Description of Artificial Sequence: Synthetic oligonucleotide
gtacgcacagtt

SEQ ID NO: 942 - DNA, 12 bp, Artificial Sequence
  Description of Artificial Sequence: Synthetic oligonucleotide
ggtaacctctga

SEQ ID NO: 943 - DNA, 12 bp, Artificial Sequence
  Description of Artificial Sequence: Synthetic oligonucleotide
gcatatgcactg

SEQ ID NO: 944 - DNA, 12 bp, Artificial Sequence
  Description of Artificial Sequence: Synthetic oligonucleotide
aacaaactgcca

SEQ ID NO: 945 - DNA, 12 bp, Artificial Sequence
  Description of Artificial Sequence: Synthetic oligonucleotide
tccagggctata

SEQ ID NO: 946 - DNA, 12 bp, Artificial Sequence
  Description of Artificial Sequence: Synthetic oligonucleotide
taccaatcggtg

SEQ ID NO: 947 - DNA, 12 bp, Artificial Sequence
  Description of Artificial Sequence: Synthetic oligonucleotide
tggactcagcta

SEQ ID NO: 948 - DNA, 12 bp, Artificial Sequence
  Description of Artificial Sequence: Synthetic oligonucleotide
agcgaacctgtt

SEQ ID NO: 949 - DNA, 12 bp, Artificial Sequence
  Description of Artificial Sequence: Synthetic oligonucleotide
caactcccgtga

SEQ ID NO: 950 - DNA, 12 bp, Artificial Sequence
  Description of Artificial Sequence: Synthetic oligonucleotide
gtagacatgtgt

SEQ ID NO: 951 - DNA, 12 bp, Artificial Sequence
  Description of Artificial Sequence: Synthetic oligonucleotide
gcgtagagagac

SEQ ID NO: 952 - DNA, 12 bp, Artificial Sequence
  Description of Artificial Sequence: Synthetic oligonucleotide
gtactcgaacca

SEQ ID NO: 953 - DNA, 12 bp, Artificial Sequence
  Description of Artificial Sequence: Synthetic oligonucleotide
acgcgctaaatc

SEQ ID NO: 954 - DNA, 12 bp, Artificial Sequence
  Description of Artificial Sequence: Synthetic oligonucleotide
acatgcacatgc

SEQ ID NO: 955 - DNA, 12 bp, Artificial Sequence
  Description of Artificial Sequence: Synthetic oligonucleotide
ttgcgttagcag

SEQ ID NO: 956 - DNA, 12 bp, Artificial Sequence
  Description of Artificial Sequence: Synthetic oligonucleotide
tacagttacgcg

SEQ ID NO: 957 - DNA, 12 bp, Artificial Sequence
  Description of Artificial Sequence: Synthetic oligonucleotide
gaaactcctaga

SEQ ID NO: 958 - DNA, 12 bp, Artificial Sequence
  Description of Artificial Sequence: Synthetic oligonucleotide
ttccggcgattg

SEQ ID NO: 959 - DNA, 12 bp, Artificial Sequence
  Description of Artificial Sequence: Synthetic oligonucleotide
gacctgaataca

SEQ ID NO: 960 - DNA, 12 bp, Artificial Sequence
  Description of Artificial Sequence: Synthetic oligonucleotide
ccttacctcctc

SEQ ID NO: 961 - DNA, 12 bp, Artificial Sequence
  Description of Artificial Sequence: Synthetic oligonucleotide
tacgagccctaa

SEQ ID NO: 962 - DNA, 12 bp, Artificial Sequence
  Description of Artificial Sequence: Synthetic oligonucleotide
caagccctagta

SEQ ID NO: 963 - DNA, 12 bp, Artificial Sequence
  Description of Artificial Sequence: Synthetic oligonucleotide
atcgggcttaac

SEQ ID NO: 964 - DNA, 12 bp, Artificial Sequence
  Description of Artificial Sequence: Synthetic oligonucleotide
gacatgcggaga

SEQ ID NO: 965 - DNA, 12 bp, Artificial Sequence
  Description of Artificial Sequence: Synthetic oligonucleotide
acgtttgtggca

SEQ ID NO: 966 - DNA, 12 bp, Artificial Sequence
  Description of Artificial Sequence: Synthetic oligonucleotide
acactggtcctg

SEQ ID NO: 967 - DNA, 12 bp, Artificial Sequence
  Description of Artificial Sequence: Synthetic oligonucleotide
cactacgctaga

SEQ ID NO: 968 - DNA, 12 bp, Artificial Sequence
  Description of Artificial Sequence: Synthetic oligonucleotide
tagtgtcggatc

SEQ ID NO: 969 - DNA, 12 bp, Artificial Sequence
  Description of Artificial Sequence: Synthetic oligonucleotide
tacgcccatcag

SEQ ID NO: 970 - DNA, 12 bp, Artificial Sequence
  Description of Artificial Sequence: Synthetic oligonucleotide
cgcacccataca

SEQ ID NO: 971 - DNA, 12 bp, Artificial Sequence
  Description of Artificial Sequence: Synthetic oligonucleotide
gcttaacgtgcc

SEQ ID NO: 972 - DNA, 12 bp, Artificial Sequence
  Description of Artificial Sequence: Synthetic oligonucleotide
agcttgaatcag

SEQ ID NO: 973 - DNA, 12 bp, Artificial Sequence
  Description of Artificial Sequence: Synthetic oligonucleotide
tgcagtcctcga

SEQ ID NO: 974 - DNA, 12 bp, Artificial Sequence
  Description of Artificial Sequence: Synthetic oligonucleotide
ctgagctctgca

SEQ ID NO: 975 - DNA, 12 bp, Artificial Sequence
  Description of Artificial Sequence: Synthetic oligonucleotide
aagatcgtactg

SEQ ID NO: 976 - DNA, 12 bp, Artificial Sequence
  Description of Artificial Sequence: Synthetic oligonucleotide
acattgaagcgt

SEQ ID NO: 977 - DNA, 12 bp, Artificial Sequence
  Description of Artificial Sequence: Synthetic oligonucleotide
gaatggatgggc

SEQ ID NO: 978 - DNA, 12 bp, Artificial Sequence
  Description of Artificial Sequence: Synthetic oligonucleotide
taaagcgaggag

SEQ ID NO: 979 - DNA, 12 bp, Artificial Sequence
  Description of Artificial Sequence: Synthetic oligonucleotide
accatagctccg

SEQ ID NO: 980 - DNA, 12 bp, Artificial Sequence
  Description of Artificial Sequence: Synthetic oligonucleotide
cttcgactttcc

SEQ ID NO: 981 - DNA, 12 bp, Artificial Sequence
  Description of Artificial Sequence: Synthetic oligonucleotide
actcatcttcca

SEQ ID NO: 982 - DNA, 12 bp, Artificial Sequence
  Description of Artificial Sequence: Synthetic oligonucleotide
gacgacatttag

SEQ ID NO: 983 - DNA, 12 bp, Artificial Sequence
  Description of Artificial Sequence: Synthetic oligonucleotide
catgaacagtgt

SEQ ID NO: 984 - DNA, 12 bp, Artificial Sequence
  Description of Artificial Sequence: Synthetic oligonucleotide
cgacaacttgtg

SEQ ID NO: 985 - DNA, 12 bp, Artificial Sequence
  Description of Artificial Sequence: Synthetic oligonucleotide
tcgacatctctt

SEQ ID NO: 986 - DNA, 12 bp, Artificial Sequence
  Description of Artificial Sequence: Synthetic oligonucleotide
gtcataagaacc

SEQ ID NO: 987 - DNA, 12 bp, Artificial Sequence
  Description of Artificial Sequence: Synthetic oligonucleotide
gagatacagttc

SEQ ID NO: 988 - DNA, 12 bp, Artificial Sequence
  Description of Artificial Sequence: Synthetic oligonucleotide
ccaactactcgg

SEQ ID NO: 989 - DNA, 12 bp, Artificial Sequence
  Description of Artificial Sequence: Synthetic oligonucleotide
gactagtcagct

SEQ ID NO: 990 - DNA, 12 bp, Artificial Sequence
  Description of Artificial Sequence: Synthetic oligonucleotide
cgctggctttag

SEQ ID NO: 991 - DNA, 12 bp, Artificial Sequence
  Description of Artificial Sequence: Synthetic oligonucleotide
gaacactttgga

SEQ ID NO: 992 - DNA, 12 bp, Artificial Sequence
  Description of Artificial Sequence: Synthetic oligonucleotide
gtccgcaagtta

SEQ ID NO: 993 - DNA, 12 bp, Artificial Sequence
  Description of Artificial Sequence: Synthetic oligonucleotide
gcatgcatccca

SEQ ID NO: 994 - DNA, 12 bp, Artificial Sequence
  Description of Artificial Sequence: Synthetic oligonucleotide
ccgttatcagcg

SEQ ID NO: 995 - DNA, 12 bp, Artificial Sequence
  Description of Artificial Sequence: Synthetic oligonucleotide
caagaaattcgc

SEQ ID NO: 996 - DNA, 12 bp, Artificial Sequence
  Description of Artificial Sequence: Synthetic oligonucleotide
gtgatacccgct

SEQ ID NO: 997 - DNA, 12 bp, Artificial Sequence
  Description of Artificial Sequence: Synthetic oligonucleotide
gagccatctgta

SEQ ID NO: 998 - DNA, 12 bp, Artificial Sequence
  Description of Artificial Sequence: Synthetic oligonucleotide
cgtagagctctc

SEQ ID NO: 999 - DNA, 12 bp, Artificial Sequence
  Description of Artificial Sequence: Synthetic oligonucleotide
gatctaatcgag

SEQ ID NO: 1000 - DNA, 12 bp, Artificial Sequence
  Description of Artificial Sequence: Synthetic oligonucleotide
tatggccaaacc

SEQ ID NO: 1001 - DNA, 12 bp, Artificial Sequence
  Description of Artificial Sequence: Synthetic oligonucleotide
aagctctcccag

SEQ ID NO: 1002 - DNA, 12 bp, Artificial Sequence
  Description of Artificial Sequence: Synthetic oligonucleotide
ccagttccaaag

SEQ ID NO: 1003 - DNA, 12 bp, Artificial Sequence
  Description of Artificial Sequence: Synthetic oligonucleotide
ttgggtacacgt

SEQ ID NO: 1004 - DNA, 12 bp, Artificial Sequence
  Description of Artificial Sequence: Synthetic oligonucleotide
cctctgagagct

SEQ ID NO: 1005 - DNA, 12 bp, Artificial Sequence
  Description of Artificial Sequence: Synthetic oligonucleotide
aatcttgcgccg

SEQ ID NO: 1006 - DNA, 12 bp, Artificial Sequence
  Description of Artificial Sequence: Synthetic oligonucleotide
tgcctaagatcg

SEQ ID NO: 1007 - DNA, 12 bp, Artificial Sequence
  Description of Artificial Sequence: Synthetic oligonucleotide
tggatctgtccg

SEQ ID NO: 1008 - DNA, 12 bp, Artificial Sequence
  Description of Artificial Sequence: Synthetic oligonucleotide
gtctggattgaa

SEQ ID NO: 1009 - DNA, 12 bp, Artificial Sequence
  Description of Artificial Sequence: Synthetic oligonucleotide
aaggcgctcctt

SEQ ID NO: 1010 - DNA, 12 bp, Artificial Sequence
  Description of Artificial Sequence: Synthetic oligonucleotide
cctcgatgcagt

SEQ ID NO: 1011 - DNA, 12 bp, Artificial Sequence
  Description of Artificial Sequence: Synthetic oligonucleotide
ggaaatcccatc

SEQ ID NO: 1012 - DNA, 12 bp, Artificial Sequence
  Description of Artificial Sequence: Synthetic oligonucleotide
ttaactggaagc

SEQ ID NO: 1013 - DNA, 12 bp, Artificial Sequence
  Description of Artificial Sequence: Synthetic oligonucleotide
cctactcggtga

SEQ ID NO: 1014 - DNA, 12 bp, Artificial Sequence
  Description of Artificial Sequence: Synthetic oligonucleotide
gcgcaatagtat

SEQ ID NO: 1015 - DNA, 12 bp, Artificial Sequence
  Description of Artificial Sequence: Synthetic oligonucleotide
taatacggatcg

SEQ ID NO: 1016 - DNA, 12 bp, Artificial Sequence
  Description of Artificial Sequence: Synthetic oligonucleotide
gcggactattca

SEQ ID NO: 1017 - DNA, 12 bp, Artificial Sequence
  Description of Artificial Sequence: Synthetic oligonucleotide
gaccgtcaatac

SEQ ID NO: 1018 - DNA, 12 bp, Artificial Sequence
  Description of Artificial Sequence: Synthetic oligonucleotide
attcgagctgtg

SEQ ID NO: 1019 - DNA, 12 bp, Artificial Sequence
  Description of Artificial Sequence: Synthetic oligonucleotide
ataccgtctttc

SEQ ID NO: 1020 - DNA, 12 bp, Artificial Sequence
  Description of Artificial Sequence: Synthetic oligonucleotide
agcgttgtccaa

SEQ ID NO: 1021 - DNA, 12 bp, Artificial Sequence
  Description of Artificial Sequence: Synthetic oligonucleotide
tcggaattagac

SEQ ID NO: 1022 - DNA, 12 bp, Artificial Sequence
  Description of Artificial Sequence: Synthetic oligonucleotide
cgtgcacaattg

SEQ ID NO: 1023 - DNA, 12 bp, Artificial Sequence
  Description of Artificial Sequence: Synthetic oligonucleotide
ttggaacggctt

SEQ ID NO: 1024 - DNA, 12 bp, Artificial Sequence
  Description of Artificial Sequence: Synthetic oligonucleotide
ggtctgttgagt

SEQ ID NO: 1025 - DNA, 12 bp, Artificial Sequence
  Description of Artificial Sequence: Synthetic oligonucleotide
aaggaccgtttc

SEQ ID NO: 1026 - DNA, 12 bp, Artificial Sequence
  Description of Artificial Sequence: Synthetic oligonucleotide
cgcctaaaccgt

SEQ ID NO: 1027 - DNA, 12 bp, Artificial Sequence
  Description of Artificial Sequence: Synthetic oligonucleotide
tgtgaattcgga

SEQ ID NO: 1028 - DNA, 12 bp, Artificial Sequence
  Description of Artificial Sequence: Synthetic oligonucleotide
cggcctaagttc

SEQ ID NO: 1029 - DNA, 12 bp, Artificial Sequence
  Description of Artificial Sequence: Synthetic oligonucleotide
tcctaggtccga

SEQ ID NO: 1030 - DNA, 12 bp, Artificial Sequence
  Description of Artificial Sequence: Synthetic oligonucleotide
ctcgtcgactga

SEQ ID NO: 1031 - DNA, 12 bp, Artificial Sequence
  Description of Artificial Sequence: Synthetic oligonucleotide
aagtaggaagga

SEQ ID NO: 1032 - DNA, 12 bp, Artificial Sequence
  Description of Artificial Sequence: Synthetic oligonucleotide
aacaccatcgac

SEQ ID NO: 1033 - DNA, 12 bp, Artificial Sequence
  Description of Artificial Sequence: Synthetic oligonucleotide
cattcgtggcgt

SEQ ID NO: 1034 - DNA, 12 bp, Artificial Sequence
  Description of Artificial Sequence: Synthetic oligonucleotide
agcgctcacatc

SEQ ID NO: 1035 - DNA, 12 bp, Artificial Sequence
  Description of Artificial Sequence: Synthetic oligonucleotide
tcctcactatca

SEQ ID NO: 1036 - DNA, 12 bp, Artificial Sequence
  Description of Artificial Sequence: Synthetic oligonucleotide
tctttcataccg

SEQ ID NO: 1037 - DNA, 12 bp, Artificial Sequence
  Description of Artificial Sequence: Synthetic oligonucleotide
cgtgccgcttaa

SEQ ID NO: 1038 - DNA, 12 bp, Artificial Sequence
  Description of Artificial Sequence: Synthetic oligonucleotide
ctatagacacga

SEQ ID NO: 1039 - DNA, 12 bp, Artificial Sequence
  Description of Artificial Sequence: Synthetic oligonucleotide
tactacgtggcc

SEQ ID NO: 1040 - DNA, 12 bp, Artificial Sequence
  Description of Artificial Sequence: Synthetic oligonucleotide
tggttatggcac

SEQ ID NO: 1041 - DNA, 12 bp, Artificial Sequence
  Description of Artificial Sequence: Synthetic oligonucleotide
gcctgcagtact

SEQ ID NO: 1042 - DNA, 12 bp, Artificial Sequence
  Description of Artificial Sequence: Synthetic oligonucleotide
cattcccgaaag

SEQ ID NO: 1043 - DNA, 12 bp, Artificial Sequence
  Description of Artificial Sequence: Synthetic oligonucleotide
gcgtcatgcatc

SEQ ID NO: 1044 - DNA, 12 bp, Artificial Sequence
  Description of Artificial Sequence: Synthetic oligonucleotide
caagagcggatg

SEQ ID NO: 1045 - DNA, 12 bp, Artificial Sequence
  Description of Artificial Sequence: Synthetic oligonucleotide
ggccagttccta

SEQ ID NO: 1046 - DNA, 12 bp, Artificial Sequence
  Description of Artificial Sequence: Synthetic oligonucleotide
cgaggttctgat

SEQ ID NO: 1047 - DNA, 12 bp, Artificial Sequence
  Description of Artificial Sequence: Synthetic oligonucleotide
gcccaagttcac

SEQ ID NO: 1048 - DNA, 12 bp, Artificial Sequence
  Description of Artificial Sequence: Synthetic oligonucleotide
ttgtcagctgga

SEQ ID NO: 1049 - DNA, 12 bp, Artificial Sequence
  Description of Artificial Sequence: Synthetic oligonucleotide
cgttggacaaat

SEQ ID NO: 1050 - DNA, 12 bp, Artificial Sequence
  Description of Artificial Sequence: Synthetic oligonucleotide
cctttggctgag

SEQ ID NO: 1051 - DNA, 12 bp, Artificial Sequence
  Description of Artificial Sequence: Synthetic oligonucleotide
gatgttcgctag

SEQ ID NO: 1052 - DNA, 12 bp, Artificial Sequence
  Description of Artificial Sequence: Synthetic oligonucleotide
aactcctgtgga

SEQ ID NO: 1053 - DNA, 12 bp, Artificial Sequence
  Description of Artificial Sequence: Synthetic oligonucleotide
ataaagaggagg

SEQ ID NO: 1054 - DNA, 12 bp, Artificial Sequence
  Description of Artificial Sequence: Synthetic oligonucleotide
atctgcgcacca

SEQ ID NO: 1055 - DNA, 12 bp, Artificial Sequence
  Description of Artificial Sequence: Synthetic oligonucleotide
ttgttgatggag

SEQ ID NO: 1056 - DNA, 12 bp, Artificial Sequence
  Description of Artificial Sequence: Synthetic oligonucleotide
cgacccatacgt

SEQ ID NO: 1057 - DNA, 12 bp, Artificial Sequence
  Description of Artificial Sequence: Synthetic oligonucleotide
ctatctcctgtc

SEQ ID NO: 1058 - DNA, 12 bp, Artificial Sequence
  Description of Artificial Sequence: Synthetic oligonucleotide
taatggtcgtag

SEQ ID NO: 1059 - DNA, 12 bp, Artificial Sequence
  Description of Artificial Sequence: Synthetic oligonucleotide
gcgccgaatctt

SEQ ID NO: 1060 - DNA, 12 bp, Artificial Sequence
  Description of Artificial Sequence: Synthetic oligonucleotide
ccacgtacgtaa

SEQ ID NO: 1061 - DNA, 12 bp, Artificial Sequence
  Description of Artificial Sequence: Synthetic oligonucleotide
cttacactgctt

SEQ ID NO: 1062 - DNA, 12 bp, Artificial Sequence
  Description of Artificial Sequence: Synthetic oligonucleotide
ctggattacggt

SEQ ID NO: 1063 - DNA, 12 bp, Artificial Sequence
  Description of Artificial Sequence: Synthetic oligonucleotide
actcacaggaat

SEQ ID NO: 1064 - DNA, 12 bp, Artificial Sequence
  Description of Artificial Sequence: Synthetic oligonucleotide
ttgcaccgtcga

SEQ ID NO: 1065 - DNA, 12 bp, Artificial Sequence
  Description of Artificial Sequence: Synthetic oligonucleotide
atcccagcatgc

SEQ ID NO: 1066 - DNA, 12 bp, Artificial Sequence
  Description of Artificial Sequence: Synthetic oligonucleotide
acgatatggtca

SEQ ID NO: 1067 - DNA, 12 bp, Artificial Sequence
  Description of Artificial Sequence: Synthetic oligonucleotide
aatgcgcgtata

SEQ ID NO: 1068 - DNA, 12 bp, Artificial Sequence
  Description of Artificial Sequence: Synthetic oligonucleotide
accacacgtagt

SEQ ID NO: 1069 - DNA, 12 bp, Artificial Sequence
  Description of Artificial Sequence: Synthetic oligonucleotide
atgatgagcctc

SEQ ID NO: 1070 - DNA, 12 bp, Artificial Sequence
  Description of Artificial Sequence: Synthetic oligonucleotide
tgctacagacgt

SEQ ID NO: 1071 - DNA, 12 bp, Artificial Sequence
  Description of Artificial Sequence: Synthetic oligonucleotide
gcttccagacaa

SEQ ID NO: 1072 - DNA, 12 bp, Artificial Sequence
  Description of Artificial Sequence: Synthetic oligonucleotide
gagacagtggaa

SEQ ID NO: 1073 - DNA, 12 bp, Artificial Sequence
  Description of Artificial Sequence: Synthetic oligonucleotide
tgccattagagc

SEQ ID NO: 1074 - DNA, 12 bp, Artificial Sequence
  Description of Artificial Sequence: Synthetic oligonucleotide
ctagtgacctag

SEQ ID NO: 1075 - DNA, 12 bp, Artificial Sequence
  Description of Artificial Sequence: Synthetic oligonucleotide
gtcgacagagga

SEQ ID NO: 1076 - DNA, 12 bp, Artificial Sequence
  Description of Artificial Sequence: Synthetic oligonucleotide
atggcctgacta

SEQ ID NO: 1077 - DNA, 12 bp, Artificial Sequence
  Description of Artificial Sequence: Synthetic oligonucleotide
acacagtcctga

SEQ ID NO: 1078 - DNA, 12 bp, Artificial Sequence
  Description of Artificial Sequence: Synthetic oligonucleotide
tcgtagtaatgg

SEQ ID NO: 1079 - DNA, 12 bp, Artificial Sequence
  Description of Artificial Sequence: Synthetic oligonucleotide
cgaagggttgga

SEQ ID NO: 1080 - DNA, 12 bp, Artificial Sequence
  Description of Artificial Sequence: Synthetic oligonucleotide
ggattcgtgtcc

SEQ ID NO: 1081 - DNA, 12 bp, Artificial Sequence
  Description of Artificial Sequence: Synthetic oligonucleotide
tgtcgcaaatag

SEQ ID NO: 1082 - DNA, 12 bp, Artificial Sequence
  Description of Artificial Sequence: Synthetic oligonucleotide
acgcacatacaa

SEQ ID NO: 1083 - DNA, 12 bp, Artificial Sequence
  Description of Artificial Sequence: Synthetic oligonucleotide
attatacggcgc

SEQ ID NO: 1084 - DNA, 12 bp, Artificial Sequence
  Description of Artificial Sequence: Synthetic oligonucleotide
aggctgtactcc

SEQ ID NO: 1085 - DNA, 12 bp, Artificial Sequence
  Description of Artificial Sequence: Synthetic oligonucleotide
gagcaacatcct

SEQ ID NO: 1086 - DNA, 12 bp, Artificial Sequence
  Description of Artificial Sequence: Synthetic oligonucleotide
gtgagataccta

SEQ ID NO: 1087 - DNA, 12 bp, Artificial Sequence
  Description of Artificial Sequence: Synthetic oligonucleotide
catccctctact

SEQ ID NO: 1088 - DNA, 12 bp, Artificial Sequence
  Description of Artificial Sequence: Synthetic oligonucleotide
tgagtggtctgt

SEQ ID NO: 1089 - DNA, 12 bp, Artificial Sequence
  Description of Artificial Sequence: Synthetic oligonucleotide
attcagatggca

SEQ ID NO: 1090 - DNA, 12 bp, Artificial Sequence
  Description of Artificial Sequence: Synthetic oligonucleotide
cggaagagaaca

SEQ ID NO: 1091 - DNA, 12 bp, Artificial Sequence
  Description of Artificial Sequence: Synthetic oligonucleotide
tcgtgttgtggc

SEQ ID NO: 1092 - DNA, 12 bp, Artificial Sequence
  Description of Artificial Sequence: Synthetic oligonucleotide
cgcggttactaa

SEQ ID NO: 1093 - DNA, 12 bp, Artificial Sequence
  Description of Artificial Sequence: Synthetic oligonucleotide
tataccgctgcg

SEQ ID NO: 1094 - DNA, 12 bp, Artificial Sequence
  Description of Artificial Sequence: Synthetic oligonucleotide
gatagcactcgt

SEQ ID NO: 1095 - DNA, 12 bp, Artificial Sequence
  Description of Artificial Sequence: Synthetic oligonucleotide
taaacgcgactc

SEQ ID NO: 1096 - DNA, 12 bp, Artificial Sequence
  Description of Artificial Sequence: Synthetic oligonucleotide
ctgcggatatac

SEQ ID NO: 1097 - DNA, 12 bp, Artificial Sequence
  Description of Artificial Sequence: Synthetic oligonucleotide
atttcgacccgg

SEQ ID NO: 1098 - DNA, 12 bp, Artificial Sequence
  Description of Artificial Sequence: Synthetic oligonucleotide
aggcccgtttac

SEQ ID NO: 1099 - DNA, 12 bp, Artificial Sequence
  Description of Artificial Sequence: Synthetic oligonucleotide
agttgaggcatt

SEQ ID NO: 1100 - DNA, 12 bp, Artificial Sequence
  Description of Artificial Sequence: Synthetic oligonucleotide
tagcgcgaactt

SEQ ID NO: 1101 - DNA, 12 bp, Artificial Sequence
  Description of Artificial Sequence: Synthetic oligonucleotide
cctcgggtacta

SEQ ID NO: 1102 - DNA, 12 bp, Artificial Sequence
  Description of Artificial Sequence: Synthetic oligonucleotide
ctagcgtgcgtt

SEQ ID NO: 1103 - DNA, 12 bp, Artificial Sequence
  Description of Artificial Sequence: Synthetic oligonucleotide
tggattgtgaac

SEQ ID NO: 1104 - DNA, 12 bp, Artificial Sequence
  Description of Artificial Sequence: Synthetic oligonucleotide
tgttgttgggaa

SEQ ID NO: 1105 - DNA, 12 bp, Artificial Sequence
  Description of Artificial Sequence: Synthetic oligonucleotide
acaatagacacc

SEQ ID NO: 1106 - DNA, 12 bp, Artificial Sequence
  Description of Artificial Sequence: Synthetic oligonucleotide
catacacgcacc

SEQ ID NO: 1107 - DNA, 12 bp, Artificial Sequence
  Description of Artificial Sequence: Synthetic oligonucleotide
ttcacctgtatc

SEQ ID NO: 1108 - DNA, 12 bp, Artificial Sequence
  Description of Artificial Sequence: Synthetic oligonucleotide
accatgtagaac

SEQ ID NO: 1109 - DNA, 12 bp, Artificial Sequence
  Description of Artificial Sequence: Synthetic oligonucleotide
ccgttggactac

SEQ ID NO: 1110 - DNA, 12 bp, Artificial Sequence
  Description of Artificial Sequence: Synthetic oligonucleotide
ctgaatctggtg

SEQ ID NO: 1111 - DNA, 12 bp, Artificial Sequence
  Description of Artificial Sequence: Synthetic oligonucleotide
cggtcaattgac

SEQ ID NO: 1112 - DNA, 12 bp, Artificial Sequence
  Description of Artificial Sequence: Synthetic oligonucleotide
acctcagtcaag

SEQ ID NO: 1113 - DNA, 12 bp, Artificial Sequence
  Description of Artificial Sequence: Synthetic oligonucleotide
ctccaggtcatg

SEQ ID NO: 1114 - DNA, 12 bp, Artificial Sequence
  Description of Artificial Sequence: Synthetic oligonucleotide
tagctcacagca

SEQ ID NO: 1115 - DNA, 12 bp, Artificial Sequence
  Description of Artificial Sequence: Synthetic oligonucleotide
tctggctacgac

SEQ ID NO: 1116 - DNA, 12 bp, Artificial Sequence
  Description of Artificial Sequence: Synthetic oligonucleotide
ggcctcactgat

SEQ ID NO: 1117 - DNA, 12 bp, Artificial Sequence
  Description of Artificial Sequence: Synthetic oligonucleotide
gtggagtctcat

SEQ ID NO: 1118 - DNA, 12 bp, Artificial Sequence
  Description of Artificial Sequence: Synthetic oligonucleotide
tcgaccaaacac

SEQ ID NO: 1119 - DNA, 12 bp, Artificial Sequence
  Description of Artificial Sequence: Synthetic oligonucleotide
caggattcgtac

SEQ ID NO: 1120 - DNA, 12 bp, Artificial Sequence
  Description of Artificial Sequence: Synthetic oligonucleotide
gtcttgggtcgt

SEQ ID NO: 1121 - DNA, 12 bp, Artificial Sequence
  Description of Artificial Sequence: Synthetic oligonucleotide
tcaggcgtaaat

SEQ ID NO: 1122 - DNA, 12 bp, Artificial Sequence
  Description of Artificial Sequence: Synthetic oligonucleotide
gtggttcgatgt

SEQ ID NO: 1123 - DNA, 12 bp, Artificial Sequence
  Description of Artificial Sequence: Synthetic oligonucleotide
gctcgaagattc

SEQ ID NO: 1124 - DNA, 12 bp, Artificial Sequence
  Description of Artificial Sequence: Synthetic oligonucleotide
ccacccagtaac

SEQ ID NO: 1125 - DNA, 12 bp, Artificial Sequence
  Description of Artificial Sequence: Synthetic oligonucleotide
cgcatacgacct

SEQ ID NO: 1126 - DNA, 12 bp, Artificial Sequence
  Description of Artificial Sequence: Synthetic oligonucleotide
ctgtatggagct

SEQ ID NO: 1127 - DNA, 12 bp, Artificial Sequence
  Description of Artificial Sequence: Synthetic oligonucleotide
tcacggtgacat

SEQ ID NO: 1128 - DNA, 12 bp, Artificial Sequence
  Description of Artificial Sequence: Synthetic oligonucleotide
tcgagagtttgc

SEQ ID NO: 1129 - DNA, 12 bp, Artificial Sequence
  Description of Artificial Sequence: Synthetic oligonucleotide
aggcttacgtgt

SEQ ID NO: 1130 - DNA, 12 bp, Artificial Sequence
  Description of Artificial Sequence: Synthetic oligonucleotide
atatcgcgatga

SEQ ID NO: 1131 - DNA, 12 bp, Artificial Sequence
  Description of Artificial Sequence: Synthetic oligonucleotide
gcctcgtactga

SEQ ID NO: 1132 - DNA, 12 bp, Artificial Sequence
  Description of Artificial Sequence: Synthetic oligonucleotide
atgcaactcgaa

SEQ ID NO: 1133 - DNA, 12 bp, Artificial Sequence
  Description of Artificial Sequence: Synthetic oligonucleotide
caaggtcacctc

SEQ ID NO: 1134 - DNA, 12 bp, Artificial Sequence
  Description of Artificial Sequence: Synthetic oligonucleotide
tacgactctggc

SEQ ID NO: 1135 - DNA, 12 bp, Artificial Sequence
  Description of Artificial Sequence: Synthetic oligonucleotide
tctctaccactc

SEQ ID NO: 1136 - DNA, 12 bp, Artificial Sequence
  Description of Artificial Sequence: Synthetic oligonucleotide
cgccggtaatct

SEQ ID NO: 1137 - DNA, 12 bp, Artificial Sequence
  Description of Artificial Sequence: Synthetic oligonucleotide
accaacagattg

SEQ ID NO: 1138 - DNA, 12 bp, Artificial Sequence
  Description of Artificial Sequence: Synthetic oligonucleotide
ctaactgacgca

SEQ ID NO: 1139 - DNA, 12 bp, Artificial Sequence
  Description of Artificial Sequence: Synthetic oligonucleotide
ctatacgcgaac

SEQ ID NO: 1140 - DNA, 12 bp, Artificial Sequence
  Description of Artificial Sequence: Synthetic oligonucleotide
gcgtaactctcg

SEQ ID NO: 1141 - DNA, 12 bp, Artificial Sequence
  Description of Artificial Sequence: Synthetic oligonucleotide
acttccaacttc

SEQ ID NO: 1142 - DNA, 12 bp, Artificial Sequence
  Description of Artificial Sequence: Synthetic oligonucleotide
ccgatgccttga

SEQ ID NO: 1143 - DNA, 12 bp, Artificial Sequence
  Description of Artificial Sequence: Synthetic oligonucleotide
gtggcctactac

SEQ ID NO: 1144 - DNA, 12 bp, Artificial Sequence
  Description of Artificial Sequence: Synthetic oligonucleotide
aacgtcctgtgc

SEQ ID NO: 1145 - DNA, 12 bp, Artificial Sequence
  Description of Artificial Sequence: Synthetic oligonucleotide
gaggagtaaagc

SEQ ID NO: 1146 - DNA, 12 bp, Artificial Sequence
  Description of Artificial Sequence: Synthetic oligonucleotide
ctttcccttcga

SEQ ID NO: 1147 - DNA, 12 bp, Artificial Sequence
  Description of Artificial Sequence: Synthetic oligonucleotide
ctcacctaggaa

SEQ ID NO: 1148 - DNA, 12 bp, Artificial Sequence
  Description of Artificial Sequence: Synthetic oligonucleotide
agcaggcacgaa

SEQ ID NO: 1149 - DNA, 12 bp, Artificial Sequence
  Description of Artificial Sequence: Synthetic oligonucleotide
ttcccttctccg

SEQ ID NO: 1150 - DNA, 12 bp, Artificial Sequence
  Description of Artificial Sequence: Synthetic oligonucleotide
agacgacgtgga

SEQ ID NO: 1151 - DNA, 12 bp, Artificial Sequence
  Description of Artificial Sequence: Synthetic oligonucleotide
gcagcatgttaa

SEQ ID NO: 1152 - DNA, 12 bp, Artificial Sequence
  Description of Artificial Sequence: Synthetic oligonucleotide
aagatttgcagc

SEQ ID NO: 1153 - DNA, 12 bp, Artificial Sequence
  Description of Artificial Sequence: Synthetic oligonucleotide
gtgttgtcgtgc

SEQ ID NO: 1154 - DNA, 12 bp, Artificial Sequence
  Description of Artificial Sequence: Synthetic oligonucleotide
tacgcagcacta

SEQ ID NO: 1155 - DNA, 12 bp, Artificial Sequence
  Description of Artificial Sequence: Synthetic oligonucleotide
catttgacgacg

SEQ ID NO: 1156 - DNA, 12 bp, Artificial Sequence
  Description of Artificial Sequence: Synthetic oligonucleotide
aaggttccgata

SEQ ID NO: 1157 - DNA, 12 bp, Artificial Sequence
  Description of Artificial Sequence: Synthetic oligonucleotide
gttgggatcctc

SEQ ID NO: 1158 - DNA, 12 bp, Artificial Sequence
  Description of Artificial Sequence: Synthetic oligonucleotide
aacggctggaag

SEQ ID NO: 1159 - DNA, 12 bp, Artificial Sequence
  Description of Artificial Sequence: Synthetic oligonucleotide
ccacagatcgat

SEQ ID NO: 1160 - DNA, 12 bp, Artificial Sequence
  Description of Artificial Sequence: Synthetic oligonucleotide
cgcttagtgctg

SEQ ID NO: 1161 - DNA, 12 bp, Artificial Sequence
  Description of Artificial Sequence: Synthetic oligonucleotide
aagtgaagcgag

SEQ ID NO: 1162 - DNA, 12 bp, Artificial Sequence
  Description of Artificial Sequence: Synthetic oligonucleotide
agtttctggtgg

SEQ ID NO: 1163 - DNA, 12 bp, Artificial Sequence
  Description of Artificial Sequence: Synthetic oligonucleotide
ttcagcgatggt

SEQ ID NO: 1164 - DNA, 12 bp, Artificial Sequence
  Description of Artificial Sequence: Synthetic oligonucleotide
atcgtccgcgat

SEQ ID NO: 1165 - DNA, 12 bp, Artificial Sequence
  Description of Artificial Sequence: Synthetic oligonucleotide
tatcgacacaag

SEQ ID NO: 1166 - DNA, 12 bp, Artificial Sequence
  Description of Artificial Sequence: Synthetic oligonucleotide
caaagtttgcga

SEQ ID NO: 1167 - DNA, 12 bp, Artificial Sequence
  Description of Artificial Sequence: Synthetic oligonucleotide
tgccgccgtaat

SEQ ID NO: 1168 - DNA, 12 bp, Artificial Sequence
  Description of Artificial Sequence: Synthetic oligonucleotide
ttcctcctgcta

SEQ ID NO: 1169 - DNA, 12 bp, Artificial Sequence
  Description of Artificial Sequence: Synthetic oligonucleotide
acaatcccgagt

SEQ ID NO: 1170 - DNA, 12 bp, Artificial Sequence
  Description of Artificial Sequence: Synthetic oligonucleotide
tcacagacaatg

SEQ ID NO: 1171 - DNA, 12 bp, Artificial Sequence
  Description of Artificial Sequence: Synthetic oligonucleotide
gattccggctca

SEQ ID NO: 1172 - DNA, 12 bp, Artificial Sequence
  Description of Artificial Sequence: Synthetic oligonucleotide
tcgagccgatct

SEQ ID NO: 1173 - DNA, 12 bp, Artificial Sequence
  Description of Artificial Sequence: Synthetic oligonucleotide
aacctcggataa

SEQ ID NO: 1174 - DNA, 12 bp, Artificial Sequence
  Description of Artificial Sequence: Synthetic oligonucleotide
catctcagtcgg

SEQ ID NO: 1175 - DNA, 12 bp, Artificial Sequence
  Description of Artificial Sequence: Synthetic oligonucleotide
gttcttggagac

SEQ ID NO: 1176 - DNA, 12 bp, Artificial Sequence
  Description of Artificial Sequence: Synthetic oligonucleotide
gagactatatgc

SEQ ID NO: 1177 - DNA, 12 bp, Artificial Sequence
  Description of Artificial Sequence: Synthetic oligonucleotide
cgtaattgccgc

SEQ ID NO: 1178 - DNA, 12 bp, Artificial Sequence
  Description of Artificial Sequence: Synthetic oligonucleotide
ctcatcatgttc

SEQ ID NO: 1179 - DNA, 12 bp, Artificial Sequence
  Description of Artificial Sequence: Synthetic oligonucleotide
gtgcttgtgtag

SEQ ID NO: 1180 - DNA, 12 bp, Artificial Sequence
  Description of Artificial Sequence: Synthetic oligonucleotide
atatgcgagact

SEQ ID NO: 1181 - DNA, 12 bp, Artificial Sequence
  Description of Artificial Sequence: Synthetic oligonucleotide
tagccctgatgc

SEQ ID NO: 1182 - DNA, 12 bp, Artificial Sequence
  Description of Artificial Sequence: Synthetic oligonucleotide
agagggtgatcg

SEQ ID NO: 1183 - DNA, 12 bp, Artificial Sequence
  Description of Artificial Sequence: Synthetic oligonucleotide
ggtgactagttc

SEQ ID NO: 1184 - DNA, 12 bp, Artificial Sequence
  Description of Artificial Sequence: Synthetic oligonucleotide
ccagggacttct

SEQ ID NO: 1185 - DNA, 12 bp, Artificial Sequence
  Description of Artificial Sequence: Synthetic oligonucleotide
caactagactcg

SEQ ID NO: 1186 - DNA, 12 bp, Artificial Sequence
  Description of Artificial Sequence: Synthetic oligonucleotide
gaccactgctgt

SEQ ID NO: 1187 - DNA, 12 bp, Artificial Sequence
  Description of Artificial Sequence: Synthetic oligonucleotide
ttgtcccaagcg

SEQ ID NO: 1188 - DNA, 12 bp, Artificial Sequence
  Description of Artificial Sequence: Synthetic oligonucleotide
tagagaatgctc

SEQ ID NO: 1189 - DNA, 12 bp, Artificial Sequence
  Description of Artificial Sequence: Synthetic oligonucleotide
atgggttccgtc

SEQ ID NO: 1190 - DNA, 12 bp, Artificial Sequence
  Description of Artificial Sequence: Synthetic oligonucleotide
gcaatccttgcg

SEQ ID NO: 1191 - DNA, 12 bp, Artificial Sequence
  Description of Artificial Sequence: Synthetic oligonucleotide
agtgcccttggt

SEQ ID NO: 1192 - DNA, 12 bp, Artificial Sequence
  Description of Artificial Sequence: Synthetic oligonucleotide
atagacactccg

SEQ ID NO: 1193 - DNA, 12 bp, Artificial Sequence
  Description of Artificial Sequence: Synthetic oligonucleotide
ttcgtacttcgt

SEQ ID NO: 1194 - DNA, 12 bp, Artificial Sequence
  Description of Artificial Sequence: Synthetic oligonucleotide
agagcatccact

SEQ ID NO: 1195 - DNA, 12 bp, Artificial Sequence
  Description of Artificial Sequence: Synthetic oligonucleotide
taggcatgcttg

SEQ ID NO: 1196 - DNA, 12 bp, Artificial Sequence
  Description of Artificial Sequence: Synthetic oligonucleotide
cctgcttccttc

SEQ ID NO: 1197 - DNA, 12 bp, Artificial Sequence
  Description of Artificial Sequence: Synthetic oligonucleotide
ggaacgacgtga

SEQ ID NO: 1198 - DNA, 12 bp, Artificial Sequence
  Description of Artificial Sequence: Synthetic oligonucleotide
gaatcgccgatt

SEQ ID NO: 1199 - DNA, 12 bp, Artificial Sequence
  Description of Artificial Sequence: Synthetic oligonucleotide
ctgctcaggcat

SEQ ID NO: 1200 - DNA, 12 bp, Artificial Sequence
  Description of Artificial Sequence: Synthetic oligonucleotide
acagtctgcatg

SEQ ID NO: 1201 - DNA, 12 bp, Artificial Sequence
  Description of Artificial Sequence: Synthetic oligonucleotide
aactagttcagg

SEQ ID NO: 1202 - DNA, 12 bp, Artificial Sequence
  Description of Artificial Sequence: Synthetic oligonucleotide
caaggcacaagg

SEQ ID NO: 1203 - DNA, 12 bp, Artificial Sequence
  Description of Artificial Sequence: Synthetic oligonucleotide
tgtcagctgtcg

SEQ ID NO: 1204 - DNA, 12 bp, Artificial Sequence
  Description of Artificial Sequence: Synthetic oligonucleotide
tagaaggctcct

SEQ ID NO: 1205 - DNA, 12 bp, Artificial Sequence
  Description of Artificial Sequence: Synthetic oligonucleotide
gacatctgacac

SEQ ID NO: 1206 - DNA, 12 bp, Artificial Sequence
  Description of Artificial Sequence: Synthetic oligonucleotide
aatcggtccgat

SEQ ID NO: 1207 - DNA, 12 bp, Artificial Sequence
  Description of Artificial Sequence: Synthetic oligonucleotide
attctgccgaag

SEQ ID NO: 1208 - DNA, 12 bp, Artificial Sequence
  Description of Artificial Sequence: Synthetic oligonucleotide
ggcctataagtc

SEQ ID NO: 1209 - DNA, 12 bp, Artificial Sequence
  Description of Artificial Sequence: Synthetic oligonucleotide
ctggtgctgaat

SEQ ID NO: 1210 - DNA, 12 bp, Artificial Sequence
  Description of Artificial Sequence: Synthetic oligonucleotide
cgactaactaga

SEQ ID NO: 1211 - DNA, 12 bp, Artificial Sequence
  Description of Artificial Sequence: Synthetic oligonucleotide
cacaaccacaac

SEQ ID NO: 1212 - DNA, 12 bp, Artificial Sequence
  Description of Artificial Sequence: Synthetic oligonucleotide
ccgttcaatgga

SEQ ID NO: 1213 - DNA, 12 bp, Artificial Sequence
  Description of Artificial Sequence: Synthetic oligonucleotide
agcatgtcccgt

SEQ ID NO: 1214 - DNA, 12 bp, Artificial Sequence
  Description of Artificial Sequence: Synthetic oligonucleotide
tccatttcatgc

SEQ ID NO: 1215 - DNA, 12 bp, Artificial Sequence
  Description of Artificial Sequence: Synthetic oligonucleotide
gacagaggtgca

SEQ ID NO: 1216 - DNA, 12 bp, Artificial Sequence
  Description of Artificial Sequence: Synthetic oligonucleotide
tacaaccgagta

SEQ ID NO: 1217 - DNA, 12 bp, Artificial Sequence
  Description of Artificial Sequence: Synthetic oligonucleotide
gcaccaatctgc

SEQ ID NO: 1218 - DNA, 12 bp, Artificial Sequence
  Description of Artificial Sequence: Synthetic oligonucleotide
ctctcggcgtaa

SEQ ID NO: 1219 - DNA, 12 bp, Artificial Sequence
  Description of Artificial Sequence: Synthetic oligonucleotide
gtacgatatgac

SEQ ID NO: 1220 - DNA, 12 bp, Artificial Sequence
  Description of Artificial Sequence: Synthetic oligonucleotide
tcggcgatcatc

SEQ ID NO: 1221 - DNA, 12 bp, Artificial Sequence
  Description of Artificial Sequence: Synthetic oligonucleotide
tcagaccaactg

SEQ ID NO: 1222 - DNA, 12 bp, Artificial Sequence
  Description of Artificial Sequence: Synthetic oligonucleotide
ctcatggtagca

SEQ ID NO: 1223 - DNA, 12 bp, Artificial Sequence
  Description of Artificial Sequence: Synthetic oligonucleotide
attagcagcgta

SEQ ID NO: 1224 - DNA, 12 bp, Artificial Sequence
  Description of Artificial Sequence: Synthetic oligonucleotide
tccctctgagag

SEQ ID NO: 1225 - DNA, 12 bp, Artificial Sequence
  Description of Artificial Sequence: Synthetic oligonucleotide
gtggtggtttcc

SEQ ID NO: 1226 - DNA, 12 bp, Artificial Sequence
  Description of Artificial Sequence: Synthetic oligonucleotide
gtttcacgcgaa

SEQ ID NO: 1227 - DNA, 12 bp, Artificial Sequence
  Description of Artificial Sequence: Synthetic oligonucleotide
agtgatgtgact

SEQ ID NO: 1228 - DNA, 12 bp, Artificial Sequence
  Description of Artificial Sequence: Synthetic oligonucleotide
aacgacacgctt

SEQ ID NO: 1229 - DNA, 12 bp, Artificial Sequence
  Description of Artificial Sequence: Synthetic oligonucleotide
tccgataatcgg

SEQ ID NO: 1230 - DNA, 12 bp, Artificial Sequence
  Description of Artificial Sequence: Synthetic oligonucleotide
aagttagtccgc

SEQ ID NO: 1231 - DNA, 12 bp, Artificial Sequence
  Description of Artificial Sequence: Synthetic oligonucleotide
tagtatgcgcaa

SEQ ID NO: 1232 - DNA, 12 bp, Artificial Sequence
  Description of Artificial Sequence: Synthetic oligonucleotide
acaagaaccttg

SEQ ID NO: 1233 - DNA, 12 bp, Artificial Sequence
  Description of Artificial Sequence: Synthetic oligonucleotide
cttagctactct

SEQ ID NO: 1234 - DNA, 12 bp, Artificial Sequence
  Description of Artificial Sequence: Synthetic oligonucleotide
cctggctgaata

SEQ ID NO: 1235 - DNA, 12 bp, Artificial Sequence
  Description of Artificial Sequence: Synthetic oligonucleotide
ctttcaggaccg

SEQ ID NO: 1236 - DNA, 12 bp, Artificial Sequence
  Description of Artificial Sequence: Synthetic oligonucleotide
tcagataccagc

SEQ ID NO: 1237 - DNA, 12 bp, Artificial Sequence
  Description of Artificial Sequence: Synthetic oligonucleotide
tgcgctgaatgt

SEQ ID NO: 1238 - DNA, 12 bp, Artificial Sequence
  Description of Artificial Sequence: Synthetic oligonucleotide
tactctcttagc

SEQ ID NO: 1239 - DNA, 12 bp, Artificial Sequence
  Description of Artificial Sequence: Synthetic oligonucleotide
tcggtccatagc

SEQ ID NO: 1240 - DNA, 12 bp, Artificial Sequence
  Description of Artificial Sequence: Synthetic oligonucleotide
ttcggatgtgaa

SEQ ID NO: 1241 - DNA, 12 bp, Artificial Sequence
  Description of Artificial Sequence: Synthetic oligonucleotide
cgtcctacagtg

SEQ ID NO: 1242 - DNA, 12 bp, Artificial Sequence
  Description of Artificial Sequence: Synthetic oligonucleotide
tcgaagacgtat

SEQ ID NO: 1243 - DNA, 12 bp, Artificial Sequence
  Description of Artificial Sequence: Synthetic oligonucleotide
atggctgtcagt

SEQ ID NO: 1244 - DNA, 12 bp, Artificial Sequence
  Description of Artificial Sequence: Synthetic oligonucleotide
aactgttcgcgc

SEQ ID NO: 1245 - DNA, 12 bp, Artificial Sequence
  Description of Artificial Sequence: Synthetic oligonucleotide
cacgtttattcc

SEQ ID NO: 1246 - DNA, 12 bp, Artificial Sequence
  Description of Artificial Sequence: Synthetic oligonucleotide
ctaggtccgact

SEQ ID NO: 1247 - DNA, 12 bp, Artificial Sequence
  Description of Artificial Sequence: Synthetic oligonucleotide
gtaactcaacag

SEQ ID NO: 1248 - DNA, 12 bp, Artificial Sequence
  Description of Artificial Sequence: Synthetic oligonucleotide
cacttctttgtg

SEQ ID NO: 1249 - DNA, 12 bp, Artificial Sequence
  Description of Artificial Sequence: Synthetic oligonucleotide
gttctcttctcg

SEQ ID NO: 1250 - DNA, 12 bp, Artificial Sequence
  Description of Artificial Sequence: Synthetic oligonucleotide
cgaagcatctac

SEQ ID NO: 1251 - DNA, 12 bp, Artificial Sequence
  Description of Artificial Sequence: Synthetic oligonucleotide
gaaacggaaacg

SEQ ID NO: 1252 - DNA, 12 bp, Artificial Sequence
  Description of Artificial Sequence: Synthetic oligonucleotide
agatcccgtacc

SEQ ID NO: 1253 - DNA, 12 bp, Artificial Sequence
  Description of Artificial Sequence: Synthetic oligonucleotide
cgtggaagacga

SEQ ID NO: 1254 - DNA, 12 bp, Artificial Sequence
  Description of Artificial Sequence: Synthetic oligonucleotide
cgtcgattgcac

SEQ ID NO: 1255 - DNA, 12 bp, Artificial Sequence
  Description of Artificial Sequence: Synthetic oligonucleotide
cgtaagatgcct

SEQ ID NO: 1256 - DNA, 12 bp, Artificial Sequence
  Description of Artificial Sequence: Synthetic oligonucleotide
gtttggccacac

SEQ ID NO: 1257 - DNA, 12 bp, Artificial Sequence
  Description of Artificial Sequence: Synthetic oligonucleotide
ggtcgtgtcttg

SEQ ID NO: 1258 - DNA, 12 bp, Artificial Sequence
  Description of Artificial Sequence: Synthetic oligonucleotide
tctggtgcatcg

SEQ ID NO: 1259 - DNA, 12 bp, Artificial Sequence
  Description of Artificial Sequence: Synthetic oligonucleotide
gagagggatcac

SEQ ID NO: 1260 - DNA, 12 bp, Artificial Sequence
  Description of Artificial Sequence: Synthetic oligonucleotide
gttgcctctgag

SEQ ID NO: 1261 - DNA, 12 bp, Artificial Sequence
  Description of Artificial Sequence: Synthetic oligonucleotide
gcgttctagctg

SEQ ID NO: 1262 - DNA, 12 bp, Artificial Sequence
  Description of Artificial Sequence: Synthetic oligonucleotide
tcaggttgccca

SEQ ID NO: 1263 - DNA, 12 bp, Artificial Sequence
  Description of Artificial Sequence: Synthetic oligonucleotide
cgtcgtctaaga

SEQ ID NO: 1264 - DNA, 12 bp, Artificial Sequence
  Description of Artificial Sequence: Synthetic oligonucleotide
cagctggttcaa

SEQ ID NO: 1265 - DNA, 12 bp, Artificial Sequence
  Description of Artificial Sequence: Synthetic oligonucleotide
tcggcttggaat

SEQ ID NO: 1266 - DNA, 12 bp, Artificial Sequence
  Description of Artificial Sequence: Synthetic oligonucleotide
cacctccaaggt

SEQ ID NO: 1267 - DNA, 12 bp, Artificial Sequence
  Description of Artificial Sequence: Synthetic oligonucleotide
gttgttctggga

SEQ ID NO: 1268 - DNA, 12 bp, Artificial Sequence
  Description of Artificial Sequence: Synthetic oligonucleotide
tcattccactca

SEQ ID NO: 1269 - DNA, 12 bp, Artificial Sequence
  Description of Artificial Sequence: Synthetic oligonucleotide
caagcgttgtcc

SEQ ID NO: 1270 - DNA, 12 bp, Artificial Sequence
  Description of Artificial Sequence: Synthetic oligonucleotide
gctggattgtca

SEQ ID NO: 1271 - DNA, 12 bp, Artificial Sequence
  Description of Artificial Sequence: Synthetic oligonucleotide
tgaacaggttca

SEQ ID NO: 1272 - DNA, 12 bp, Artificial Sequence
  Description of Artificial Sequence: Synthetic oligonucleotide
gtaagcctcgat

SEQ ID NO: 1273 - DNA, 12 bp, Artificial Sequence
  Description of Artificial Sequence: Synthetic oligonucleotide
ggacttccagct

SEQ ID NO: 1274 - DNA, 12 bp, Artificial Sequence
  Description of Artificial Sequence: Synthetic oligonucleotide
gtcacatcacga

SEQ ID NO: 1275 - DNA, 12 bp, Artificial Sequence
  Description of Artificial Sequence: Synthetic oligonucleotide
gacttatgcccg

SEQ ID NO: 1276 - DNA, 12 bp, Artificial Sequence
  Description of Artificial Sequence: Synthetic oligonucleotide
tcttgtttctgg

SEQ ID NO: 1277 - DNA, 12 bp, Artificial Sequence
  Description of Artificial Sequence: Synthetic oligonucleotide
gagagatcgacg

SEQ ID NO: 1278 - DNA, 12 bp, Artificial Sequence
  Description of Artificial Sequence: Synthetic oligonucleotide
ctccgctatagg

SEQ ID NO: 1279 - DNA, 12 bp, Artificial Sequence
  Description of Artificial Sequence: Synthetic oligonucleotide
ctcacaaccgtg

SEQ ID NO: 1280 - DNA, 12 bp, Artificial Sequence
  Description of Artificial Sequence: Synthetic oligonucleotide
cgacatttctct

SEQ ID NO: 1281 - DNA, 12 bp, Artificial Sequence
  Description of Artificial Sequence: Synthetic oligonucleotide
gtgacgttagtc

SEQ ID NO: 1282 - DNA, 12 bp, Artificial Sequence
  Description of Artificial Sequence: Synthetic oligonucleotide
ttgaacaagcca

SEQ ID NO: 1283 - DNA, 12 bp, Artificial Sequence
  Description of Artificial Sequence: Synthetic oligonucleotide
atacaaacgcac

SEQ ID NO: 1284 - DNA, 12 bp, Artificial Sequence
  Description of Artificial Sequence: Synthetic oligonucleotide
actgctatcgcg

SEQ ID NO: 1285 - DNA, 12 bp, Artificial Sequence
  Description of Artificial Sequence: Synthetic oligonucleotide
ctgctattcctc

SEQ ID NO: 1286 - DNA, 12 bp, Artificial Sequence
  Description of Artificial Sequence: Synthetic oligonucleotide
ggacgttaacta

SEQ ID NO: 1287 - DNA, 12 bp, Artificial Sequence
  Description of Artificial Sequence: Synthetic oligonucleotide
gagtcttggtaa

SEQ ID NO: 1288 - DNA, 12 bp, Artificial Sequence
  Description of Artificial Sequence: Synthetic oligonucleotide
ccaggttaatgc

SEQ ID NO: 1289 - DNA, 12 bp, Artificial Sequence
  Description of Artificial Sequence: Synthetic oligonucleotide
gattcactgtgg

SEQ ID NO: 1290 - DNA, 12 bp, Artificial Sequence
  Description of Artificial Sequence: Synthetic oligonucleotide
accacttgccag

SEQ ID NO: 1291 - DNA, 12 bp, Artificial Sequence
  Description of Artificial Sequence: Synthetic oligonucleotide
atgtcaccgctg

SEQ ID NO: 1292 - DNA, 12 bp, Artificial Sequence
  Description of Artificial Sequence: Synthetic oligonucleotide
tagcagttgcgt

SEQ ID NO: 1293 - DNA, 12 bp, Artificial Sequence
  Description of Artificial Sequence: Synthetic oligonucleotide
tcgtcgccaaac

SEQ ID NO: 1294 - DNA, 12 bp, Artificial Sequence
  Description of Artificial Sequence: Synthetic oligonucleotide
attcgtacctct

SEQ ID NO: 1295 - DNA, 12 bp, Artificial Sequence
  Description of Artificial Sequence: Synthetic oligonucleotide
gcttgccaatcg

SEQ ID NO: 1296 - DNA, 12 bp, Artificial Sequence
  Description of Artificial Sequence: Synthetic oligonucleotide
accagaaatgtc

SEQ ID NO: 1297 - DNA, 12 bp, Artificial Sequence
  Description of Artificial Sequence: Synthetic oligonucleotide
tgtaacgccgat

SEQ ID NO: 1298 - DNA, 12 bp, Artificial Sequence
  Description of Artificial Sequence: Synthetic oligonucleotide
cacgctattgga

SEQ ID NO: 1299 - DNA, 12 bp, Artificial Sequence
  Description of Artificial Sequence: Synthetic oligonucleotide
aacatgcatgcc

SEQ ID NO: 1300 - DNA, 12 bp, Artificial Sequence
  Description of Artificial Sequence: Synthetic oligonucleotide
tagcgttccaga

SEQ ID NO: 1301 - DNA, 12 bp, Artificial Sequence
  Description of Artificial Sequence: Synthetic oligonucleotide
ctgacacgaata

SEQ ID NO: 1302 - DNA, 12 bp, Artificial Sequence
  Description of Artificial Sequence: Synthetic oligonucleotide
atgcttgctctt

SEQ ID NO: 1303 - DNA, 12 bp, Artificial Sequence
  Description of Artificial Sequence: Synthetic oligonucleotide
agcagaacatct

SEQ ID NO: 1304 - DNA, 12 bp, Artificial Sequence
  Description of Artificial Sequence: Synthetic oligonucleotide
aacttcacttcc

SEQ ID NO: 1305 - DNA, 12 bp, Artificial Sequence
  Description of Artificial Sequence: Synthetic oligonucleotide
gtctgttgagtg

SEQ ID NO: 1306 - DNA, 12 bp, Artificial Sequence
  Description of Artificial Sequence: Synthetic oligonucleotide
ccagaagtgttc

SEQ ID NO: 1307 - DNA, 12 bp, Artificial Sequence
  Description of Artificial Sequence: Synthetic oligonucleotide
gttctaaggtga

SEQ ID NO: 1308 - DNA, 12 bp, Artificial Sequence
  Description of Artificial Sequence: Synthetic oligonucleotide
acagttgtacgc

SEQ ID NO: 1309 - DNA, 12 bp, Artificial Sequence
  Description of Artificial Sequence: Synthetic oligonucleotide
tggagtaggtgg

SEQ ID NO: 1310 - DNA, 12 bp, Artificial Sequence
  Description of Artificial Sequence: Synthetic oligonucleotide
ccagtggatata

SEQ ID NO: 1311 - DNA, 12 bp, Artificial Sequence
  Description of Artificial Sequence: Synthetic oligonucleotide
tgagttcggtcc

SEQ ID NO: 1312 - DNA, 12 bp, Artificial Sequence
  Description of Artificial Sequence: Synthetic oligonucleotide
acgatcatctgg

SEQ ID NO: 1313 - DNA, 12 bp, Artificial Sequence
  Description of Artificial Sequence: Synthetic oligonucleotide
cgtgaatcaacc

SEQ ID NO: 1314 - DNA, 12 bp, Artificial Sequence
  Description of Artificial Sequence: Synthetic oligonucleotide
agctactgcgtc

SEQ ID NO: 1315 - DNA, 12 bp, Artificial Sequence
  Description of Artificial Sequence: Synthetic oligonucleotide
ttggctctattc

SEQ ID NO: 1316 - DNA, 12 bp, Artificial Sequence
  Description of Artificial Sequence: Synthetic oligonucleotide
tgtgtgtaacgc

SEQ ID NO: 1317 - DNA, 12 bp, Artificial Sequence
  Description of Artificial Sequence: Synthetic oligonucleotide
ttacgtggcgat

SEQ ID NO: 1318 - DNA, 12 bp, Artificial Sequence
  Description of Artificial Sequence: Synthetic oligonucleotide
actgtacatgag

SEQ ID NO: 1319 - DNA, 12 bp, Artificial Sequence
  Description of Artificial Sequence: Synthetic oligonucleotide
gagctaagttac

SEQ ID NO: 1320 - DNA, 12 bp, Artificial Sequence
  Description of Artificial Sequence: Synthetic oligonucleotide
actgcccgatac

SEQ ID NO: 1321 - DNA, 12 bp, Artificial Sequence
  Description of Artificial Sequence: Synthetic oligonucleotide
gatcccacgtac

SEQ ID NO: 1322 - DNA, 12 bp, Artificial Sequence
  Description of Artificial Sequence: Synthetic oligonucleotide
ccaatcgtgcaa

SEQ ID NO: 1323 - DNA, 12 bp, Artificial Sequence
  Description of Artificial Sequence: Synthetic oligonucleotide
caatgcctcacg

SEQ ID NO: 1324 - DNA, 12 bp, Artificial Sequence
  Description of Artificial Sequence: Synthetic oligonucleotide
tgcccggactta

SEQ ID NO: 1325 - DNA, 12 bp, Artificial Sequence
  Description of Artificial Sequence: Synthetic oligonucleotide
agcgattcctcg

SEQ ID NO: 1326 - DNA, 12 bp, Artificial Sequence
  Description of Artificial Sequence: Synthetic oligonucleotide
cacagcgtccta

SEQ ID NO: 1327 - DNA, 12 bp, Artificial Sequence
  Description of Artificial Sequence: Synthetic oligonucleotide
taccgcttcttc

SEQ ID NO: 1328 - DNA, 12 bp, Artificial Sequence
  Description of Artificial Sequence: Synthetic oligonucleotide
aggctagcagag

SEQ ID NO: 1329 - DNA, 12 bp, Artificial Sequence
  Description of Artificial Sequence: Synthetic oligonucleotide
tgtacggataac

SEQ ID NO: 1330 - DNA, 12 bp, Artificial Sequence
  Description of Artificial Sequence: Synthetic oligonucleotide
atcccgtacgtg

SEQ ID NO: 1331 - DNA, 12 bp, Artificial Sequence
  Description of Artificial Sequence: Synthetic oligonucleotide
ccaacccagatc

SEQ ID NO: 1332 - DNA, 12 bp, Artificial Sequence
  Description of Artificial Sequence: Synthetic oligonucleotide
acgtccactgtg

SEQ ID NO: 1333 - DNA, 12 bp, Artificial Sequence
  Description of Artificial Sequence: Synthetic oligonucleotide
tgtgcgataaca

SEQ ID NO: 1334 - DNA, 12 bp, Artificial Sequence
  Description of Artificial Sequence: Synthetic oligonucleotide
gtcactccgaac

SEQ ID NO: 1335 - DNA, 12 bp, Artificial Sequence
  Description of Artificial Sequence: Synthetic oligonucleotide
aatcaactaggc

SEQ ID NO: 1336 - DNA, 12 bp, Artificial Sequence
  Description of Artificial Sequence: Synthetic oligonucleotide
cttgttgttctg

SEQ ID NO: 1337 - DNA, 12 bp, Artificial Sequence
  Description of Artificial Sequence: Synthetic oligonucleotide
gattgctaccag

SEQ ID NO: 1338 - DNA, 12 bp, Artificial Sequence
  Description of Artificial Sequence: Synthetic oligonucleotide
cgctaatcgtga

SEQ ID NO: 1339 - DNA, 12 bp, Artificial Sequence
  Description of Artificial Sequence: Synthetic oligonucleotide
gattatcgacga

SEQ ID NO: 1340 - DNA, 12 bp, Artificial Sequence
  Description of Artificial Sequence: Synthetic oligonucleotide
caccgaaatctg

SEQ ID NO: 1341 - DNA, 12 bp, Artificial Sequence
  Description of Artificial Sequence: Synthetic oligonucleotide
gtgagggcaagt

SEQ ID NO: 1342 - DNA, 12 bp, Artificial Sequence
  Description of Artificial Sequence: Synthetic oligonucleotide
tgacagaatcca

SEQ ID NO: 1343 - DNA, 12 bp, Artificial Sequence
  Description of Artificial Sequence: Synthetic oligonucleotide
ggctctaacgta

SEQ ID NO: 1344 - DNA, 12 bp, Artificial Sequence
  Description of Artificial Sequence: Synthetic oligonucleotide
ggccgttcgatt

SEQ ID NO: 1345 - DNA, 12 bp, Artificial Sequence
  Description of Artificial Sequence: Synthetic oligonucleotide
gcctagcccaat

SEQ ID NO: 1346 - DNA, 12 bp, Artificial Sequence
  Description of Artificial Sequence: Synthetic oligonucleotide
tgacgtagaact

SEQ ID NO: 1347 - DNA, 12 bp, Artificial Sequence
  Description of Artificial Sequence: Synthetic oligonucleotide
cgtgggctcatt

SEQ ID NO: 1348 - DNA, 12 bp, Artificial Sequence
  Description of Artificial Sequence: Synthetic oligonucleotide
cactgtatgaag

SEQ ID NO: 1349 - DNA, 12 bp, Artificial Sequence
  Description of Artificial Sequence: Synthetic oligonucleotide
aatctgcaccga

SEQ ID NO: 1350 - DNA, 12 bp, Artificial Sequence
  Description of Artificial Sequence: Synthetic oligonucleotide
ggaacttactcg

SEQ ID NO: 1351 - DNA, 12 bp, Artificial Sequence
  Description of Artificial Sequence: Synthetic oligonucleotide
gatgtatgtggt

SEQ ID NO: 1352 - DNA, 12 bp, Artificial Sequence
  Description of Artificial Sequence: Synthetic oligonucleotide
ctatgccggcta

SEQ ID NO: 1353 - DNA, 12 bp, Artificial Sequence
  Description of Artificial Sequence: Synthetic oligonucleotide
cgtaccagatcc

SEQ ID NO: 1354 - DNA, 12 bp, Artificial Sequence
  Description of Artificial Sequence: Synthetic oligonucleotide
tggatgcgcatt

SEQ ID NO: 1355 - DNA, 12 bp, Artificial Sequence
  Description of Artificial Sequence: Synthetic oligonucleotide
ccagccttcaga

SEQ ID NO: 1356 - DNA, 12 bp, Artificial Sequence
  Description of Artificial Sequence: Synthetic oligonucleotide
cagttacccaag

SEQ ID NO: 1357 - DNA, 12 bp, Artificial Sequence
  Description of Artificial Sequence: Synthetic oligonucleotide
actccttgtgtt

SEQ ID NO: 1358 - DNA, 12 bp, Artificial Sequence
  Description of Artificial Sequence: Synthetic oligonucleotide
gtggtatgggag

SEQ ID NO: 1359 - DNA, 12 bp, Artificial Sequence
  Description of Artificial Sequence: Synthetic oligonucleotide
atgtttagacgg

SEQ ID NO: 1360 - DNA, 12 bp, Artificial Sequence
  Description of Artificial Sequence: Synthetic oligonucleotide
gcccatatcaga

SEQ ID NO: 1361 - DNA, 12 bp, Artificial Sequence
  Description of Artificial Sequence: Synthetic oligonucleotide
ccgtgttagaca

SEQ ID NO: 1362 - DNA, 12 bp, Artificial Sequence
  Description of Artificial Sequence: Synthetic oligonucleotide
gagggacgcaat

SEQ ID NO: 1363 - DNA, 12 bp, Artificial Sequence
  Description of Artificial Sequence: Synthetic oligonucleotide
gtcacggacatt

SEQ ID NO: 1364 - DNA, 12 bp, Artificial Sequence
  Description of Artificial Sequence: Synthetic oligonucleotide
tgtaccaaccga

SEQ ID NO: 1365 - DNA, 12 bp, Artificial Sequence
  Description of Artificial Sequence: Synthetic oligonucleotide
acatgtcacgtg

SEQ ID NO: 1366 - DNA, 12 bp, Artificial Sequence
  Description of Artificial Sequence: Synthetic oligonucleotide
cgtgtgtgctca

SEQ ID NO: 1367 - DNA, 12 bp, Artificial Sequence
  Description of Artificial Sequence: Synthetic oligonucleotide
acctctattcgt

SEQ ID NO: 1368 - DNA, 12 bp, Artificial Sequence
  Description of Artificial Sequence: Synthetic oligonucleotide
taggccatgtaa

SEQ ID NO: 1369 - DNA, 12 bp, Artificial Sequence
  Description of Artificial Sequence: Synthetic oligonucleotide
gcgagcgaagta

SEQ ID NO: 1370 - DNA, 12 bp, Artificial Sequence
  Description of Artificial Sequence: Synthetic oligonucleotide
agggtacagggt

SEQ ID NO: 1371 - DNA, 12 bp, Artificial Sequence
  Description of Artificial Sequence: Synthetic oligonucleotide
ctttagcgctgg

SEQ ID NO: 1372 - DNA, 12 bp, Artificial Sequence
  Description of Artificial Sequence: Synthetic oligonucleotide
atccatgagcgt

SEQ ID NO: 1373 - DNA, 12 bp, Artificial Sequence
  Description of Artificial Sequence: Synthetic oligonucleotide
ggcaaggcacaa

SEQ ID NO: 1374 - DNA, 12 bp, Artificial Sequence
  Description of Artificial Sequence: Synthetic oligonucleotide
aaccgtcgccta

SEQ ID NO: 1375 - DNA, 12 bp, Artificial Sequence
  Description of Artificial Sequence: Synthetic oligonucleotide
atctaccgaagc

SEQ ID NO: 1376 - DNA, 12 bp, Artificial Sequence
  Description of Artificial Sequence: Synthetic oligonucleotide
agagtgctaatc

SEQ ID NO: 1377 - DNA, 12 bp, Artificial Sequence
  Description of Artificial Sequence: Synthetic oligonucleotide
ctggtcttacgg

SEQ ID NO: 1378 - DNA, 12 bp, Artificial Sequence
  Description of Artificial Sequence: Synthetic oligonucleotide
tagacttcagag

SEQ ID NO: 1379 - DNA, 12 bp, Artificial Sequence
  Description of Artificial Sequence: Synthetic oligonucleotide
gccattatagag

SEQ ID NO: 1380 - DNA, 12 bp, Artificial Sequence
  Description of Artificial Sequence: Synthetic oligonucleotide
ttacgaagttgg

SEQ ID NO: 1381 - DNA, 12 bp, Artificial Sequence
  Description of Artificial Sequence: Synthetic oligonucleotide
acttggtgtaag

SEQ ID NO: 1382 - DNA, 12 bp, Artificial Sequence
  Description of Artificial Sequence: Synthetic oligonucleotide
ttggcgggttat

SEQ ID NO: 1383 - DNA, 12 bp, Artificial Sequence
  Description of Artificial Sequence: Synthetic oligonucleotide
caagtcgaatac

SEQ ID NO: 1384 - DNA, 12 bp, Artificial Sequence
  Description of Artificial Sequence: Synthetic oligonucleotide
tgattcccggtg

SEQ ID NO: 1385 - DNA, 12 bp, Artificial Sequence
  Description of Artificial Sequence: Synthetic oligonucleotide
taaccgaaccac

SEQ ID NO: 1386 - DNA, 12 bp, Artificial Sequence
  Description of Artificial Sequence: Synthetic oligonucleotide
agatagctcgct

SEQ ID NO: 1387 - DNA, 12 bp, Artificial Sequence
  Description of Artificial Sequence: Synthetic oligonucleotide
tcttggaggtca

SEQ ID NO: 1388 - DNA, 12 bp, Artificial Sequence
  Description of Artificial Sequence: Synthetic oligonucleotide
cacgatggtcat

SEQ ID NO: 1389 - DNA, 12 bp, Artificial Sequence
  Description of Artificial Sequence: Synthetic oligonucleotide
gcaagtgtgagg

SEQ ID NO: 1390 - DNA, 12 bp, Artificial Sequence
  Description of Artificial Sequence: Synthetic oligonucleotide
agttccacggct

SEQ ID NO: 1391 - DNA, 12 bp, Artificial Sequence
  Description of Artificial Sequence: Synthetic oligonucleotide
ggtgcgtcactt

SEQ ID NO: 1392 - DNA, 12 bp, Artificial Sequence
  Description of Artificial Sequence: Synthetic oligonucleotide
ctggttggcatc

SEQ ID NO: 1393 - DNA, 12 bp, Artificial Sequence
  Description of Artificial Sequence: Synthetic oligonucleotide
tcacctccttgt

SEQ ID NO: 1394 - DNA, 12 bp, Artificial Sequence
  Description of Artificial Sequence: Synthetic oligonucleotide
gtcaccaatccg

SEQ ID NO: 1395 - DNA, 12 bp, Artificial Sequence
  Description of Artificial Sequence: Synthetic oligonucleotide
ctcggtcaacca

SEQ ID NO: 1396 - DNA, 12 bp, Artificial Sequence
  Description of Artificial Sequence: Synthetic oligonucleotide
ggaagcttaact

SEQ ID NO: 1397 - DNA, 12 bp, Artificial Sequence
  Description of Artificial Sequence: Synthetic oligonucleotide
tgtgcttgtagg

SEQ ID NO: 1398 - DNA, 12 bp, Artificial Sequence
  Description of Artificial Sequence: Synthetic oligonucleotide
ctgcttcttaca

SEQ ID NO: 1399 - DNA, 12 bp, Artificial Sequence
  Description of Artificial Sequence: Synthetic oligonucleotide
gcacacctgata

SEQ ID NO: 1400 - DNA, 12 bp, Artificial Sequence
  Description of Artificial Sequence: Synthetic oligonucleotide
cactaacaaacg

SEQ ID NO: 1401 - DNA, 12 bp, Artificial Sequence
  Description of Artificial Sequence: Synthetic oligonucleotide
accctattgcgg

SEQ ID NO: 1402 - DNA, 12 bp, Artificial Sequence
  Description of Artificial Sequence: Synthetic oligonucleotide
ggagacgttctt

SEQ ID NO: 1403 - DNA, 12 bp, Artificial Sequence
  Description of Artificial Sequence: Synthetic oligonucleotide
tgactctgcggt

SEQ ID NO: 1404 - DNA, 12 bp, Artificial Sequence
  Description of Artificial Sequence: Synthetic oligonucleotide
gttcgagtgaat

SEQ ID NO: 1405 - DNA, 12 bp, Artificial Sequence
  Description of Artificial Sequence: Synthetic oligonucleotide
gcgacaattaca

SEQ ID NO: 1406 - DNA, 12 bp, Artificial Sequence
  Description of Artificial Sequence: Synthetic oligonucleotide
ttccaggcagat

SEQ ID NO: 1407 - DNA, 12 bp, Artificial Sequence
  Description of Artificial Sequence: Synthetic oligonucleotide
tccgttcgttta

SEQ ID NO: 1408 - DNA, 12 bp, Artificial Sequence
  Description of Artificial Sequence: Synthetic oligonucleotide
attgcgctaccg

SEQ ID NO: 1409 - DNA, 12 bp, Artificial Sequence
  Description of Artificial Sequence: Synthetic oligonucleotide
gtacactgatag

SEQ ID NO: 1410 - DNA, 12 bp, Artificial Sequence
  Description of Artificial Sequence: Synthetic oligonucleotide
ttcttctaccgc

SEQ ID NO: 1411 - DNA, 12 bp, Artificial Sequence
  Description of Artificial Sequence: Synthetic oligonucleotide
tcatgctccatt

SEQ ID NO: 1412 - DNA, 12 bp, Artificial Sequence
  Description of Artificial Sequence: Synthetic oligonucleotide
tatggtacccag

SEQ ID NO: 1413 - DNA, 12 bp, Artificial Sequence
  Description of Artificial Sequence: Synthetic oligonucleotide
accaccgtaacc

SEQ ID NO: 1414 - DNA, 12 bp, Artificial Sequence
  Description of Artificial Sequence: Synthetic oligonucleotide
ccgaccagctta

SEQ ID NO: 1415 - DNA, 12 bp, Artificial Sequence
  Description of Artificial Sequence: Synthetic oligonucleotide
ttacatcccttg

SEQ ID NO: 1416 - DNA, 12 bp, Artificial Sequence
  Description of Artificial Sequence: Synthetic oligonucleotide
tctctcgatcat

SEQ ID NO: 1417 - DNA, 12 bp, Artificial Sequence
  Description of Artificial Sequence: Synthetic oligonucleotide
agctgtcaagct

SEQ ID NO: 1418 - DNA, 12 bp, Artificial Sequence
  Description of Artificial Sequence: Synthetic oligonucleotide
cacgacttgaca

SEQ ID NO: 1419 - DNA, 12 bp, Artificial Sequence
  Description of Artificial Sequence: Synthetic oligonucleotide
catttcgcactt

SEQ ID NO: 1420 - DNA, 12 bp, Artificial Sequence
  Description of Artificial Sequence: Synthetic oligonucleotide
caatccaccgaa

SEQ ID NO: 1421 - DNA, 12 bp, Artificial Sequence
  Description of Artificial Sequence: Synthetic oligonucleotide
ggtgtgagaaag

SEQ ID NO: 1422 - DNA, 12 bp, Artificial Sequence
  Description of Artificial Sequence: Synthetic oligonucleotide
aatccatgacag

SEQ ID NO: 1423 - DNA, 12 bp, Artificial Sequence
  Description of Artificial Sequence: Synthetic oligonucleotide
gagagcaacaga

SEQ ID NO: 1424 - DNA, 12 bp, Artificial Sequence
  Description of Artificial Sequence: Synthetic oligonucleotide
cttggaggctta

SEQ ID NO: 1425 - DNA, 12 bp, Artificial Sequence
  Description of Artificial Sequence: Synthetic oligonucleotide
ttaagcgcctga

SEQ ID NO: 1426 - DNA, 12 bp, Artificial Sequence
  Description of Artificial Sequence: Synthetic oligonucleotide
tacgcgtacagt

SEQ ID NO: 1427 - DNA, 12 bp, Artificial Sequence
  Description of Artificial Sequence: Synthetic oligonucleotide
ctctttgtcgat

SEQ ID NO: 1428 - DNA, 12 bp, Artificial Sequence
  Description of Artificial Sequence: Synthetic oligonucleotide
ggtattcaaagc

SEQ ID NO: 1429 - DNA, 12 bp, Artificial Sequence
  Description of Artificial Sequence: Synthetic oligonucleotide
tactcgggaact

SEQ ID NO: 1430 - DNA, 12 bp, Artificial Sequence
  Description of Artificial Sequence: Synthetic oligonucleotide
acgtggttccac

SEQ ID NO: 1431 - DNA, 12 bp, Artificial Sequence
  Description of Artificial Sequence: Synthetic oligonucleotide
tgcgggattcat

SEQ ID NO: 1432 - DNA, 12 bp, Artificial Sequence
  Description of Artificial Sequence: Synthetic oligonucleotide
ccgtcaagatgt

SEQ ID NO: 1433 - DNA, 12 bp, Artificial Sequence
  Description of Artificial Sequence: Synthetic oligonucleotide
gtgaactggatt

SEQ ID NO: 1434 - DNA, 12 bp, Artificial Sequence
  Description of Artificial Sequence: Synthetic oligonucleotide
ggtccacctaac

SEQ ID NO: 1435 - DNA, 12 bp, Artificial Sequence
  Description of Artificial Sequence: Synthetic oligonucleotide
cgtgcttaggct

SEQ ID NO: 1436 - DNA, 12 bp, Artificial Sequence
  Description of Artificial Sequence: Synthetic oligonucleotide
gacgctttgctg

SEQ ID NO: 1437 - DNA, 12 bp, Artificial Sequence
  Description of Artificial Sequence: Synthetic oligonucleotide
caaactgcgttg

SEQ ID NO: 1438 - DNA, 12 bp, Artificial Sequence
  Description of Artificial Sequence: Synthetic oligonucleotide
tacacgctgatg

SEQ ID NO: 1439 - DNA, 12 bp, Artificial Sequence
  Description of Artificial Sequence: Synthetic oligonucleotide
cctaacggtcca

SEQ ID NO: 1440 - DNA, 12 bp, Artificial Sequence
  Description of Artificial Sequence: Synthetic oligonucleotide
tgatcactcttc

SEQ ID NO: 1441 - DNA, 12 bp, Artificial Sequence
  Description of Artificial Sequence: Synthetic oligonucleotide
taccgaaggtat

SEQ ID NO: 1442 - DNA, 12 bp, Artificial Sequence
  Description of Artificial Sequence: Synthetic oligonucleotide
acagggtttgta

SEQ ID NO: 1443 - DNA, 12 bp, Artificial Sequence
  Description of Artificial Sequence: Synthetic oligonucleotide
ttagactcggaa

SEQ ID NO: 1444 - DNA, 12 bp, Artificial Sequence
  Description of Artificial Sequence: Synthetic oligonucleotide
cgtttcaaggac

SEQ ID NO: 1445 - DNA, 12 bp, Artificial Sequence
  Description of Artificial Sequence: Synthetic oligonucleotide
tgtagccgcttg

SEQ ID NO: 1446 - DNA, 12 bp, Artificial Sequence
  Description of Artificial Sequence: Synthetic oligonucleotide
ggcacgaaaggt

SEQ ID NO: 1447 - DNA, 12 bp, Artificial Sequence
  Description of Artificial Sequence: Synthetic oligonucleotide
cactcatcattc

SEQ ID NO: 1448 - DNA, 12 bp, Artificial Sequence
  Description of Artificial Sequence: Synthetic oligonucleotide
gcctatgagatc

SEQ ID NO: 1449 - DNA, 12 bp, Artificial Sequence
  Description of Artificial Sequence: Synthetic oligonucleotide
gaccgataggga

SEQ ID NO: 1450 - DNA, 12 bp, Artificial Sequence
  Description of Artificial Sequence: Synthetic oligonucleotide
gcagaacttagt

SEQ ID NO: 1451 - DNA, 12 bp, Artificial Sequence
  Description of Artificial Sequence: Synthetic oligonucleotide
tacccgactaag

SEQ ID NO: 1452 - DNA, 12 bp, Artificial Sequence
  Description of Artificial Sequence: Synthetic oligonucleotide
catgagactgta

SEQ ID NO: 1453 - DNA, 12 bp, Artificial Sequence
  Description of Artificial Sequence: Synthetic oligonucleotide
gtatttcggacg

SEQ ID NO: 1454 - DNA, 12 bp, Artificial Sequence
  Description of Artificial Sequence: Synthetic oligonucleotide
caaacctatggc

SEQ ID NO: 1455 - DNA, 12 bp, Artificial Sequence
  Description of Artificial Sequence: Synthetic oligonucleotide
ggcgaactgaag

SEQ ID NO: 1456 - DNA, 12 bp, Artificial Sequence
  Description of Artificial Sequence: Synthetic oligonucleotide
acccgttgatga

SEQ ID NO: 1457 - DNA, 12 bp, Artificial Sequence
  Description of Artificial Sequence: Synthetic oligonucleotide
cgtagtaccaca

SEQ ID NO: 1458 - DNA, 12 bp, Artificial Sequence
  Description of Artificial Sequence: Synthetic oligonucleotide
ggtcatcacgat

SEQ ID NO: 1459 - DNA, 12 bp, Artificial Sequence
  Description of Artificial Sequence: Synthetic oligonucleotide
tatctatcctgc

SEQ ID NO: 1460 - DNA, 12 bp, Artificial Sequence
  Description of Artificial Sequence: Synthetic oligonucleotide
atcgcttaaggc

SEQ ID NO: 1461 - DNA, 12 bp, Artificial Sequence
  Description of Artificial Sequence: Synthetic oligonucleotide
cggcactatcac

SEQ ID NO: 1462 - DNA, 12 bp, Artificial Sequence
  Description of Artificial Sequence: Synthetic oligonucleotide
gacgtagaacgg

SEQ ID NO: 1463 - DNA, 12 bp, Artificial Sequence
  Description of Artificial Sequence: Synthetic oligonucleotide
cggagagacatg

SEQ ID NO: 1464 - DNA, 12 bp, Artificial Sequence
  Description of Artificial Sequence: Synthetic oligonucleotide
agtctagagtac

SEQ ID NO: 1465 - DNA, 12 bp, Artificial Sequence
  Description of Artificial Sequence: Synthetic oligonucleotide
ttgccaagagtc

SEQ ID NO: 1466 - DNA, 12 bp, Artificial Sequence
  Description of Artificial Sequence: Synthetic oligonucleotide
accatccaacga

SEQ ID NO: 1467 - DNA, 12 bp, Artificial Sequence
  Description of Artificial Sequence: Synthetic oligonucleotide
aggtggtggagt

SEQ ID NO: 1468 - DNA, 12 bp, Artificial Sequence
  Description of Artificial Sequence: Synthetic oligonucleotide
cggtacctacca

SEQ ID NO: 1469 - DNA, 12 bp, Artificial Sequence
  Description of Artificial Sequence: Synthetic oligonucleotide
ccaaagccagtt

SEQ ID NO: 1470 - DNA, 12 bp, Artificial Sequence
  Description of Artificial Sequence: Synthetic oligonucleotide
tgcgcaaaggag

SEQ ID NO: 1471 - DNA, 12 bp, Artificial Sequence
  Description of Artificial Sequence: Synthetic oligonucleotide
agtagcggaaga

SEQ ID NO: 1472 - DNA, 12 bp, Artificial Sequence
  Description of Artificial Sequence: Synthetic oligonucleotide
gcaataggagga

SEQ ID NO: 1473 - DNA, 12 bp, Artificial Sequence
  Description of Artificial Sequence: Synthetic oligonucleotide
attcccagaacg

SEQ ID NO: 1474 - DNA, 12 bp, Artificial Sequence
  Description of Artificial Sequence: Synthetic oligonucleotide
gcgtttgctagc

SEQ ID NO: 1475 - DNA, 12 bp, Artificial Sequence
  Description of Artificial Sequence: Synthetic oligonucleotide
tacgatgagttg

SEQ ID NO: 1476 - DNA, 12 bp, Artificial Sequence
  Description of Artificial Sequence: Synthetic oligonucleotide
ggtttgcacatg

SEQ ID NO: 1477 - DNA, 12 bp, Artificial Sequence
  Description of Artificial Sequence: Synthetic oligonucleotide
gcaattaggtac

SEQ ID NO: 1478 - DNA, 12 bp, Artificial Sequence
  Description of Artificial Sequence: Synthetic oligonucleotide
ccgaacgtcact

SEQ ID NO: 1479 - DNA, 12 bp, Artificial Sequence
  Description of Artificial Sequence: Synthetic oligonucleotide
agacgttgctac

SEQ ID NO: 1480 - DNA, 12 bp, Artificial Sequence
  Description of Artificial Sequence: Synthetic oligonucleotide
agaaacagctct

SEQ ID NO: 1481 - DNA, 12 bp, Artificial Sequence
  Description of Artificial Sequence: Synthetic oligonucleotide
gcttggtaggtt

SEQ ID NO: 1482 - DNA, 12 bp, Artificial Sequence
  Description of Artificial Sequence: Synthetic oligonucleotide
tgggttaacaca

SEQ ID NO: 1483 - DNA, 12 bp, Artificial Sequence
  Description of Artificial Sequence: Synthetic oligonucleotide
cataccgtgagt

SEQ ID NO: 1484 - DNA, 12 bp, Artificial Sequence
  Description of Artificial Sequence: Synthetic oligonucleotide
acaccaacacca

SEQ ID NO: 1485 - DNA, 12 bp, Artificial Sequence
  Description of Artificial Sequence: Synthetic oligonucleotide
agaatagcgctt

SEQ ID NO: 1486 - DNA, 12 bp, Artificial Sequence
  Description of Artificial Sequence: Synthetic oligonucleotide
ctcagactcaga

SEQ ID NO: 1487 - DNA, 12 bp, Artificial Sequence
  Description of Artificial Sequence: Synthetic oligonucleotide
ccggaatccata

SEQ ID NO: 1488 - DNA, 12 bp, Artificial Sequence
  Description of Artificial Sequence: Synthetic oligonucleotide
taggttgcttgg

SEQ ID NO: 1489 - DNA, 12 bp, Artificial Sequence
  Description of Artificial Sequence: Synthetic oligonucleotide
atgtgtgtagac

SEQ ID NO: 1490 - DNA, 12 bp, Artificial Sequence
  Description of Artificial Sequence: Synthetic oligonucleotide
ccatcacatagg

SEQ ID NO: 1491 - DNA, 12 bp, Artificial Sequence
  Description of Artificial Sequence: Synthetic oligonucleotide
aagcgtacattg

SEQ ID NO: 1492 - DNA, 12 bp, Artificial Sequence
  Description of Artificial Sequence: Synthetic oligonucleotide
ccgagtacaatc

SEQ ID NO: 1493 - DNA, 12 bp, Artificial Sequence
  Description of Artificial Sequence: Synthetic oligonucleotide
atcggcttccga

SEQ ID NO: 1494 - DNA, 12 bp, Artificial Sequence
  Description of Artificial Sequence: Synthetic oligonucleotide
caggaaccagga

SEQ ID NO: 1495 - DNA, 12 bp, Artificial Sequence
  Description of Artificial Sequence: Synthetic oligonucleotide
cctgcgaagtat

SEQ ID NO: 1496 - DNA, 12 bp, Artificial Sequence
  Description of Artificial Sequence: Synthetic oligonucleotide
cgacacggagaa

SEQ ID NO: 1497 - DNA, 12 bp, Artificial Sequence
  Description of Artificial Sequence: Synthetic oligonucleotide
gttatgacggat

SEQ ID NO: 1498 - DNA, 12 bp, Artificial Sequence
  Description of Artificial Sequence: Synthetic oligonucleotide
gatatgaactgc

SEQ ID NO: 1499 - DNA, 12 bp, Artificial Sequence
  Description of Artificial Sequence: Synthetic oligonucleotide
cactagacccac

SEQ ID NO: 1500 - DNA, 12 bp, Artificial Sequence
  Description of Artificial Sequence: Synthetic oligonucleotide
tgctcgatgtgc

SEQ ID NO: 1501 - DNA, 12 bp, Artificial Sequence
  Description of Artificial Sequence: Synthetic oligonucleotide
ttctctcgacat

SEQ ID NO: 1502 - DNA, 12 bp, Artificial Sequence
  Description of Artificial Sequence: Synthetic oligonucleotide
gaacctatgaca

SEQ ID NO: 1503 - DNA, 12 bp, Artificial Sequence
  Description of Artificial Sequence: Synthetic oligonucleotide
agcctcatgatg

SEQ ID NO: 1504 - DNA, 12 bp, Artificial Sequence
  Description of Artificial Sequence: Synthetic oligonucleotide
gcagtctaagat

SEQ ID NO: 1505 - DNA, 12 bp, Artificial Sequence
  Description of Artificial Sequence: Synthetic oligonucleotide
ggaaaggagaat

SEQ ID NO: 1506 - DNA, 12 bp, Artificial Sequence
  Description of Artificial Sequence: Synthetic oligonucleotide
aggtttggcttg

SEQ ID NO: 1507 - DNA, 12 bp, Artificial Sequence
  Description of Artificial Sequence: Synthetic oligonucleotide
gctctccgtaga

SEQ ID NO: 1508 - DNA, 12 bp, Artificial Sequence
  Description of Artificial Sequence: Synthetic oligonucleotide
atgccggtaata

SEQ ID NO: 1509 - DNA, 12 bp, Artificial Sequence
  Description of Artificial Sequence: Synthetic oligonucleotide
gtgtatcgccac

SEQ ID NO: 1510 - DNA, 12 bp, Artificial Sequence
  Description of Artificial Sequence: Synthetic oligonucleotide
cggcgcattata

SEQ ID NO: 1511 - DNA, 12 bp, Artificial Sequence
  Description of Artificial Sequence: Synthetic oligonucleotide
gagtatctgagt

SEQ ID NO: 1512 - DNA, 12 bp, Artificial Sequence
  Description of Artificial Sequence: Synthetic oligonucleotide
tactccaggctg

SEQ ID NO: 1513 - DNA, 12 bp, Artificial Sequence
  Description of Artificial Sequence: Synthetic oligonucleotide
gttaagctgacc

SEQ ID NO: 1514 - DNA, 12 bp, Artificial Sequence
  Description of Artificial Sequence: Synthetic oligonucleotide
gaacagctctac

SEQ ID NO: 1515 - DNA, 12 bp, Artificial Sequence
  Description of Artificial Sequence: Synthetic oligonucleotide
ccaaactcgtcg

SEQ ID NO: 1516 - DNA, 12 bp, Artificial Sequence
  Description of Artificial Sequence: Synthetic oligonucleotide
ggtgctaatcac

SEQ ID NO: 1517 - DNA, 12 bp, Artificial Sequence
  Description of Artificial Sequence: Synthetic oligonucleotide
ctcgctagatag

SEQ ID NO: 1518 - DNA, 12 bp, Artificial Sequence
  Description of Artificial Sequence: Synthetic oligonucleotide
ttcggcatagtg

SEQ ID NO: 1519 - DNA, 12 bp, Artificial Sequence
  Description of Artificial Sequence: Synthetic oligonucleotide
atgccatgccgt

SEQ ID NO: 1520 - DNA, 12 bp, Artificial Sequence
  Description of Artificial Sequence: Synthetic oligonucleotide
gtgagtcatacc

SEQ ID NO: 1521 - DNA, 12 bp, Artificial Sequence
  Description of Artificial Sequence: Synthetic oligonucleotide
acgtgaggaacg

SEQ ID NO: 1522 - DNA, 12 bp, Artificial Sequence
  Description of Artificial Sequence: Synthetic oligonucleotide
cgtttggaatga

SEQ ID NO: 1523 - DNA, 12 bp, Artificial Sequence
  Description of Artificial Sequence: Synthetic oligonucleotide
ccaggacaggaa

SEQ ID NO: 1524 - DNA, 12 bp, Artificial Sequence
  Description of Artificial Sequence: Synthetic oligonucleotide
gtgccataatcg

SEQ ID NO: 1525 - DNA, 12 bp, Artificial Sequence
  Description of Artificial Sequence: Synthetic oligonucleotide
gacattgtcacg

SEQ ID NO: 1526 - DNA, 12 bp, Artificial Sequence
  Description of Artificial Sequence: Synthetic oligonucleotide
tggccgttactg

SEQ ID NO: 1527 - DNA, 12 bp, Artificial Sequence
  Description of Artificial Sequence: Synthetic oligonucleotide
tgaatcgaagct

SEQ ID NO: 1528 - DNA, 12 bp, Artificial Sequence
  Description of Artificial Sequence: Synthetic oligonucleotide
ggttagagcgga

SEQ ID NO: 1529 - DNA, 12 bp, Artificial Sequence
  Description of Artificial Sequence: Synthetic oligonucleotide
aagggttagtct

SEQ ID NO: 1530 - DNA, 12 bp, Artificial Sequence
  Description of Artificial Sequence: Synthetic oligonucleotide
tgcagatccaac

SEQ ID NO: 1531 - DNA, 12 bp, Artificial Sequence
  Description of Artificial Sequence: Synthetic oligonucleotide
gccaacaaccat

SEQ ID NO: 1532 - DNA, 12 bp, Artificial Sequence
  Description of Artificial Sequence: Synthetic oligonucleotide
tagagctgccat

SEQ ID NO: 1533 - DNA, 12 bp, Artificial Sequence
  Description of Artificial Sequence: Synthetic oligonucleotide
ctgcagtaagta

SEQ ID NO: 1534 - DNA, 12 bp, Artificial Sequence
  Description of Artificial Sequence: Synthetic oligonucleotide
gtagtagaccat

SEQ ID NO: 1535 - DNA, 12 bp, Artificial Sequence
  Description of Artificial Sequence: Synthetic oligonucleotide
gtgactagtgat

SEQ ID NO: 1536 - DNA, 12 bp, Artificial Sequence
  Description of Artificial Sequence: Synthetic oligonucleotide
tcactcttgtac

SEQ ID NO: 1537 - DNA, 12 bp, Artificial Sequence
  Description of Artificial Sequence: Synthetic oligonucleotide
atcagtactagg

SEQ ID NO: 1538 - DNA, 12 bp, Artificial Sequence
  Description of Artificial Sequence: Synthetic oligonucleotide
atctagtggcaa

SEQ ID NO: 1539 - DNA, 12 bp, Artificial Sequence
  Description of Artificial Sequence: Synthetic oligonucleotide
tataggctccgc

SEQ ID NO: 1540 - DNA, 12 bp, Artificial Sequence
  Description of Artificial Sequence: Synthetic oligonucleotide
atcaagatacgc

SEQ ID NO: 1541 - DNA, 12 bp, Artificial Sequence
  Description of Artificial Sequence: Synthetic oligonucleotide
ggccttcagtca

SEQ ID NO: 1542 - DNA, 12 bp, Artificial Sequence
  Description of Artificial Sequence: Synthetic oligonucleotide
tggtggagtttc

SEQ ID NO: 1543 - DNA, 12 bp, Artificial Sequence
  Description of Artificial Sequence: Synthetic oligonucleotide
tcctcgagcgat

SEQ ID NO: 1544 - DNA, 12 bp, Artificial Sequence
  Description of Artificial Sequence: Synthetic oligonucleotide
ccttcaatggga

SEQ ID NO: 1545 - DNA, 12 bp, Artificial Sequence
  Description of Artificial Sequence: Synthetic oligonucleotide
atcgtgtgttgg

SEQ ID NO: 1546 - DNA, 12 bp, Artificial Sequence
  Description of Artificial Sequence: Synthetic oligonucleotide
tctatctggctt

SEQ ID NO: 1547 - DNA, 12 bp, Artificial Sequence
  Description of Artificial Sequence: Synthetic oligonucleotide
acacgtttgggt

SEQ ID NO: 1548 - DNA, 12 bp, Artificial Sequence
  Description of Artificial Sequence: Synthetic oligonucleotide
agaacacggaag

SEQ ID NO: 1549 - DNA, 12 bp, Artificial Sequence
  Description of Artificial Sequence: Synthetic oligonucleotide
acccaagcgtta

SEQ ID NO: 1550 - DNA, 12 bp, Artificial Sequence
  Description of Artificial Sequence: Synthetic oligonucleotide
ttgacgacatcg

SEQ ID NO: 1551 - DNA, 12 bp, Artificial Sequence
  Description of Artificial Sequence: Synthetic oligonucleotide
cttccgcagaca

SEQ ID NO: 1552 - DNA, 12 bp, Artificial Sequence
  Description of Artificial Sequence: Synthetic oligonucleotide
ggaaacaaacgg

SEQ ID NO: 1553 - DNA, 12 bp, Artificial Sequence
  Description of Artificial Sequence: Synthetic oligonucleotide
cgaacgtctatg

SEQ ID NO: 1554 - DNA, 12 bp, Artificial Sequence
  Description of Artificial Sequence: Synthetic oligonucleotide
tcgaaacatgca

SEQ ID NO: 1555 - DNA, 12 bp, Artificial Sequence
  Description of Artificial Sequence: Synthetic oligonucleotide
tgcagcaagatt

SEQ ID NO: 1556 - DNA, 12 bp, Artificial Sequence
  Description of Artificial Sequence: Synthetic oligonucleotide
acatactgagca

SEQ ID NO: 1557 - DNA, 12 bp, Artificial Sequence
  Description of Artificial Sequence: Synthetic oligonucleotide
gcactatacgca

SEQ ID NO: 1558 - DNA, 12 bp, Artificial Sequence
  Description of Artificial Sequence: Synthetic oligonucleotide
gattggcatagt

SEQ ID NO: 1559 - DNA, 12 bp, Artificial Sequence
  Description of Artificial Sequence: Synthetic oligonucleotide
tcatgtgaacga

SEQ ID NO: 1560 - DNA, 12 bp, Artificial Sequence
  Description of Artificial Sequence: Synthetic oligonucleotide
aactaaggactc

SEQ ID NO: 1561 - DNA, 12 bp, Artificial Sequence
  Description of Artificial Sequence: Synthetic oligonucleotide
agcaacattgca

SEQ ID NO: 1562 - DNA, 12 bp, Artificial Sequence
  Description of Artificial Sequence: Synthetic oligonucleotide
ggctaaactatg

SEQ ID NO: 1563 - DNA, 12 bp, Artificial Sequence
  Description of Artificial Sequence: Synthetic oligonucleotide
tctgggcattga

SEQ ID NO: 1564 - DNA, 12 bp, Artificial Sequence
  Description of Artificial Sequence: Synthetic oligonucleotide
gagttgtacgat

SEQ ID NO: 1565 - DNA, 12 bp, Artificial Sequence
  Description of Artificial Sequence: Synthetic oligonucleotide
tctccgttccct

SEQ ID NO: 1566 - DNA, 12 bp, Artificial Sequence
  Description of Artificial Sequence: Synthetic oligonucleotide
aactcaatagcg

SEQ ID NO: 1567 - DNA, 12 bp, Artificial Sequence
  Description of Artificial Sequence: Synthetic oligonucleotide
gatgtggtgtta

SEQ ID NO: 1568 - DNA, 12 bp, Artificial Sequence
  Description of Artificial Sequence: Synthetic oligonucleotide
aagagcagagcc

SEQ ID NO: 1569 - DNA, 12 bp, Artificial Sequence
  Description of Artificial Sequence: Synthetic oligonucleotide
ccaatgataagc

SEQ ID NO: 1570 - DNA, 12 bp, Artificial Sequence
  Description of Artificial Sequence: Synthetic oligonucleotide
ctcgaaatgcaa

SEQ ID NO: 1571 - DNA, 12 bp, Artificial Sequence
  Description of Artificial Sequence: Synthetic oligonucleotide
ctgattacgaga

SEQ ID NO: 1572 - DNA, 12 bp, Artificial Sequence
  Description of Artificial Sequence: Synthetic oligonucleotide
cttagaacgtgc

SEQ ID NO: 1573 - DNA, 12 bp, Artificial Sequence
  Description of Artificial Sequence: Synthetic oligonucleotide
cagaaatgtgtc

SEQ ID NO: 1574 - DNA, 12 bp, Artificial Sequence
  Description of Artificial Sequence: Synthetic oligonucleotide
ggagagatcacg

SEQ ID NO: 1575 - DNA, 12 bp, Artificial Sequence
  Description of Artificial Sequence: Synthetic oligonucleotide
ttaaaccgcgcc

SEQ ID NO: 1576 - DNA, 12 bp, Artificial Sequence
  Description of Artificial Sequence: Synthetic oligonucleotide
agaagaaaggca

SEQ ID NO: 1577 - DNA, 12 bp, Artificial Sequence
  Description of Artificial Sequence: Synthetic oligonucleotide
tctgaatggtag

SEQ ID NO: 1578 - DNA, 12 bp, Artificial Sequence
  Description of Artificial Sequence: Synthetic oligonucleotide
ccgtatatgcgc

SEQ ID NO: 1579 - DNA, 12 bp, Artificial Sequence
  Description of Artificial Sequence: Synthetic oligonucleotide
gtagaggtagag

SEQ ID NO: 1580 - DNA, 12 bp, Artificial Sequence
  Description of Artificial Sequence: Synthetic oligonucleotide
tcaacccgtgaa

SEQ ID NO: 1581 - DNA, 12 bp, Artificial Sequence
  Description of Artificial Sequence: Synthetic oligonucleotide
cttgcataccgg

SEQ ID NO: 1582 - DNA, 12 bp, Artificial Sequence
  Description of Artificial Sequence: Synthetic oligonucleotide
ccactctctcta

SEQ ID NO: 1583 - DNA, 12 bp, Artificial Sequence
  Description of Artificial Sequence: Synthetic oligonucleotide
catcgttggtcg

SEQ ID NO: 1584 - DNA, 12 bp, Artificial Sequence
  Description of Artificial Sequence: Synthetic oligonucleotide
tatgacgtacga

SEQ ID NO: 1585 - DNA, 12 bp, Artificial Sequence
  Description of Artificial Sequence: Synthetic oligonucleotide
cgtgatccgcta

SEQ ID NO: 1586 - DNA, 12 bp, Artificial Sequence
  Description of Artificial Sequence: Synthetic oligonucleotide
gtttgaaacacg

SEQ ID NO: 1587 - DNA, 12 bp, Artificial Sequence
  Description of Artificial Sequence: Synthetic oligonucleotide
gtgcacgataat

SEQ ID NO: 1588 - DNA, 12 bp, Artificial Sequence
  Description of Artificial Sequence: Synthetic oligonucleotide
cctcctaattca

SEQ ID NO: 1589 - DNA, 12 bp, Artificial Sequence
  Description of Artificial Sequence: Synthetic oligonucleotide
tagatcctcgga

SEQ ID NO: 1590 - DNA, 12 bp, Artificial Sequence
  Description of Artificial Sequence: Synthetic oligonucleotide
tctctgaacagg

SEQ ID NO: 1591 - DNA, 12 bp, Artificial Sequence
  Description of Artificial Sequence: Synthetic oligonucleotide
ggttatttggcg

SEQ ID NO: 1592 - DNA, 12 bp, Artificial Sequence
  Description of Artificial Sequence: Synthetic oligonucleotide
agagagacaggt

SEQ ID NO: 1593 - DNA, 12 bp, Artificial Sequence
  Description of Artificial Sequence: Synthetic oligonucleotide
ggtctaggtcta

SEQ ID NO: 1594 - DNA, 12 bp, Artificial Sequence
  Description of Artificial Sequence: Synthetic oligonucleotide
ttcatggccagc

SEQ ID NO: 1595 - DNA, 12 bp, Artificial Sequence
  Description of Artificial Sequence: Synthetic oligonucleotide
tcggacagtgtt

SEQ ID NO: 1596 - DNA, 12 bp, Artificial Sequence
  Description of Artificial Sequence: Synthetic oligonucleotide
cctttatagtcc

SEQ ID NO: 1597 - DNA, 12 bp, Artificial Sequence
  Description of Artificial Sequence: Synthetic oligonucleotide
ggatcgtaatac

SEQ ID NO: 1598 - DNA, 12 bp, Artificial Sequence
  Description of Artificial Sequence: Synthetic oligonucleotide
tcgccagtgcat

SEQ ID NO: 1599 - DNA, 12 bp, Artificial Sequence
  Description of Artificial Sequence: Synthetic oligonucleotide
tcaggacgtatc

SEQ ID NO: 1600 - DNA, 12 bp, Artificial Sequence
  Description of Artificial Sequence: Synthetic oligonucleotide
attggacacgct

SEQ ID NO: 1601 - DNA, 12 bp, Artificial Sequence
  Description of Artificial Sequence: Synthetic oligonucleotide
tgatgtgctaag

SEQ ID NO: 1602 - DNA, 12 bp, Artificial Sequence
  Description of Artificial Sequence: Synthetic oligonucleotide
tgtaggtgtgct

SEQ ID NO: 1603 - DNA, 12 bp, Artificial Sequence
  Description of Artificial Sequence: Synthetic oligonucleotide
gcatagcatcaa

SEQ ID NO: 1604 - DNA, 12 bp, Artificial Sequence
  Description of Artificial Sequence: Synthetic oligonucleotide
gctcaggactct

SEQ ID NO: 1605 - DNA, 12 bp, Artificial Sequence
  Description of Artificial Sequence: Synthetic oligonucleotide
gaaaggtgagaa

SEQ ID NO: 1606 - DNA, 12 bp, Artificial Sequence
  Description of Artificial Sequence: Synthetic oligonucleotide
aattcacctcct

SEQ ID NO: 1607 - DNA, 12 bp, Artificial Sequence
  Description of Artificial Sequence: Synthetic oligonucleotide
cagtaaatcgca

SEQ ID NO: 1608 - DNA, 12 bp, Artificial Sequence
  Description of Artificial Sequence: Synthetic oligonucleotide
tcccacgaaaca

SEQ ID NO: 1609 - DNA, 12 bp, Artificial Sequence
  Description of Artificial Sequence: Synthetic oligonucleotide
gtgttagatgtg

SEQ ID NO: 1610 - DNA, 12 bp, Artificial Sequence
  Description of Artificial Sequence: Synthetic oligonucleotide
cactttgggtgc

SEQ ID NO: 1611 - DNA, 12 bp, Artificial Sequence
  Description of Artificial Sequence: Synthetic oligonucleotide
gaatatacctgg

SEQ ID NO: 1612 - DNA, 12 bp, Artificial Sequence
  Description of Artificial Sequence: Synthetic oligonucleotide
atgaagcactgt

SEQ ID NO: 1613 - DNA, 12 bp, Artificial Sequence
  Description of Artificial Sequence: Synthetic oligonucleotide
caagtttccgcg

SEQ ID NO: 1614 - DNA, 12 bp, Artificial Sequence
  Description of Artificial Sequence: Synthetic oligonucleotide
tacgctacgacc

SEQ ID NO: 1615 - DNA, 12 bp, Artificial Sequence
  Description of Artificial Sequence: Synthetic oligonucleotide
ttagagccatgc

SEQ ID NO: 1616 - DNA, 12 bp, Artificial Sequence
  Description of Artificial Sequence: Synthetic oligonucleotide
tctagcctggca

SEQ ID NO: 1617 - DNA, 12 bp, Artificial Sequence
  Description of Artificial Sequence: Synthetic oligonucleotide
gtcgcttgcaca

SEQ ID NO: 1618 - DNA, 12 bp, Artificial Sequence
  Description of Artificial Sequence: Synthetic oligonucleotide
ttgatgtgaggt

SEQ ID NO: 1619 - DNA, 12 bp, Artificial Sequence
  Description of Artificial Sequence: Synthetic oligonucleotide
acatcgttgacg

SEQ ID NO: 1620 - DNA, 12 bp, Artificial Sequence
  Description of Artificial Sequence: Synthetic oligonucleotide
gtcagtatggct

SEQ ID NO: 1621 - DNA, 12 bp, Artificial Sequence
  Description of Artificial Sequence: Synthetic oligonucleotide
tgaaccctatgg

SEQ ID NO: 1622 - DNA, 12 bp, Artificial Sequence
  Description of Artificial Sequence: Synthetic oligonucleotide
aatgcaatgcgt

SEQ ID NO: 1623 - DNA, 12 bp, Artificial Sequence
  Description of Artificial Sequence: Synthetic oligonucleotide
tctaccacgaag

SEQ ID NO: 1624 - DNA, 12 bp, Artificial Sequence
  Description of Artificial Sequence: Synthetic oligonucleotide
tcttgcggagtc

SEQ ID NO: 1625 - DNA, 12 bp, Artificial Sequence
  Description of Artificial Sequence: Synthetic oligonucleotide
acgaaagagcag

SEQ ID NO: 1626 - DNA, 12 bp, Artificial Sequence
  Description of Artificial Sequence: Synthetic oligonucleotide
ccatatcccgga

SEQ ID NO: 1627 - DNA, 12 bp, Artificial Sequence
  Description of Artificial Sequence: Synthetic oligonucleotide
agagtcttgcca

SEQ ID NO: 1628 - DNA, 12 bp, Artificial Sequence
  Description of Artificial Sequence: Synthetic oligonucleotide
cgaatgagtcat

SEQ ID NO: 1629 - DNA, 12 bp, Artificial Sequence
  Description of Artificial Sequence: Synthetic oligonucleotide
aatatcgggatc

SEQ ID NO: 1630 - DNA, 12 bp, Artificial Sequence
  Description of Artificial Sequence: Synthetic oligonucleotide
ttagtcgtgacg

SEQ ID NO: 1631 - DNA, 12 bp, Artificial Sequence
  Description of Artificial Sequence: Synthetic oligonucleotide
tgatgaacccgt

SEQ ID NO: 1632 - DNA, 12 bp, Artificial Sequence
  Description of Artificial Sequence: Synthetic oligonucleotide
tcgtaccaggat

SEQ ID NO: 1633 - DNA, 12 bp, Artificial Sequence
  Description of Artificial Sequence: Synthetic oligonucleotide
acaacactccga

SEQ ID NO: 1634 - DNA, 12 bp, Artificial Sequence
  Description of Artificial Sequence: Synthetic oligonucleotide
caacgctagaat

SEQ ID NO: 1635 - DNA, 12 bp, Artificial Sequence
  Description of Artificial Sequence: Synthetic oligonucleotide
tagtgcattcgg

SEQ ID NO: 1636 - DNA, 12 bp, Artificial Sequence
  Description of Artificial Sequence: Synthetic oligonucleotide
tgccagaccact

SEQ ID NO: 1637 - DNA, 12 bp, Artificial Sequence
  Description of Artificial Sequence: Synthetic oligonucleotide
gctcttatgctt

SEQ ID NO: 1638 - DNA, 12 bp, Artificial Sequence
  Description of Artificial Sequence: Synthetic oligonucleotide
agtgactgtcaa

SEQ ID NO: 1639 - DNA, 12 bp, Artificial Sequence
  Description of Artificial Sequence: Synthetic oligonucleotide
cgatgctgttga

SEQ ID NO: 1640 - DNA, 12 bp, Artificial Sequence
  Description of Artificial Sequence: Synthetic oligonucleotide
atcagagcccat

SEQ ID NO: 1641 - DNA, 12 bp, Artificial Sequence
  Description of Artificial Sequence: Synthetic oligonucleotide
tcaatgaccgca

SEQ ID NO: 1642 - DNA, 12 bp, Artificial Sequence
  Description of Artificial Sequence: Synthetic oligonucleotide
aggctccatgta

SEQ ID NO: 1643 - DNA, 12 bp, Artificial Sequence
  Description of Artificial Sequence: Synthetic oligonucleotide
cgacctcgcata

SEQ ID NO: 1644 - DNA, 12 bp, Artificial Sequence
  Description of Artificial Sequence: Synthetic oligonucleotide
ggtgagcaagca

SEQ ID NO: 1645 - DNA, 12 bp, Artificial Sequence
  Description of Artificial Sequence: Synthetic oligonucleotide
acgactgcataa

SEQ ID NO: 1646 - DNA, 12 bp, Artificial Sequence
  Description of Artificial Sequence: Synthetic oligonucleotide
tctgtagagcca

SEQ ID NO: 1647 - DNA, 12 bp, Artificial Sequence
  Description of Artificial Sequence: Synthetic oligonucleotide
ctatcggaagat

SEQ ID NO: 1648 - DNA, 12 bp, Artificial Sequence
  Description of Artificial Sequence: Synthetic oligonucleotide
actactgaggat

SEQ ID NO: 1649 - DNA, 12 bp, Artificial Sequence
  Description of Artificial Sequence: Synthetic oligonucleotide
ctaattctctgc

SEQ ID NO: 1650 - DNA, 12 bp, Artificial Sequence
  Description of Artificial Sequence: Synthetic oligonucleotide
agttcatacggc

SEQ ID NO: 1651 - DNA, 12 bp, Artificial Sequence
  Description of Artificial Sequence: Synthetic oligonucleotide
acgcgaactaat

SEQ ID NO: 1652 - DNA, 12 bp, Artificial Sequence
  Description of Artificial Sequence: Synthetic oligonucleotide
ccgactctaggt

SEQ ID NO: 1653 - DNA, 12 bp, Artificial Sequence
  Description of Artificial Sequence: Synthetic oligonucleotide
cggattgctgta

SEQ ID NO: 1654 - DNA, 12 bp, Artificial Sequence
  Description of Artificial Sequence: Synthetic oligonucleotide
tatctggaagtg

SEQ ID NO: 1655 - DNA, 12 bp, Artificial Sequence
  Description of Artificial Sequence: Synthetic oligonucleotide
ggaagtggccaa

SEQ ID NO: 1656 - DNA, 12 bp, Artificial Sequence
  Description of Artificial Sequence: Synthetic oligonucleotide
tcgctttaacct

SEQ ID NO: 1657 - DNA, 12 bp, Artificial Sequence
  Description of Artificial Sequence: Synthetic oligonucleotide
agctatgtatgg

SEQ ID NO: 1658 - DNA, 12 bp, Artificial Sequence
  Description of Artificial Sequence: Synthetic oligonucleotide
atcctacgagca

SEQ ID NO: 1659 - DNA, 12 bp, Artificial Sequence
  Description of Artificial Sequence: Synthetic oligonucleotide
ggtactgtacca

SEQ ID NO: 1660 - DNA, 12 bp, Artificial Sequence
  Description of Artificial Sequence: Synthetic oligonucleotide
cagctatggact

SEQ ID NO: 1661 - DNA, 12 bp, Artificial Sequence
  Description of Artificial Sequence: Synthetic oligonucleotide
gataatgtgcac

SEQ ID NO: 1662 - DNA, 12 bp, Artificial Sequence
  Description of Artificial Sequence: Synthetic oligonucleotide
ggcttacttgga

SEQ ID NO: 1663 - DNA, 12 bp, Artificial Sequence
  Description of Artificial Sequence: Synthetic oligonucleotide
acgggtcatcat

SEQ ID NO: 1664 - DNA, 12 bp, Artificial Sequence
  Description of Artificial Sequence: Synthetic oligonucleotide
gacaacgaatct

SEQ ID NO: 1665 - DNA, 12 bp, Artificial Sequence
  Description of Artificial Sequence: Synthetic oligonucleotide
atcgaatcgagt

SEQ ID NO: 1666 - DNA, 12 bp, Artificial Sequence
  Description of Artificial Sequence: Synthetic oligonucleotide
ttgctggacgct

SEQ ID NO: 1667 - DNA, 12 bp, Artificial Sequence
  Description of Artificial Sequence: Synthetic oligonucleotide
ctctgaggtaac

SEQ ID NO: 1668 - DNA, 12 bp, Artificial Sequence
  Description of Artificial Sequence: Synthetic oligonucleotide
ccatccgcaaca

SEQ ID NO: 1669 - DNA, 12 bp, Artificial Sequence
  Description of Artificial Sequence: Synthetic oligonucleotide
gaaacatcccac

SEQ ID NO: 1670 - DNA, 12 bp, Artificial Sequence
  Description of Artificial Sequence: Synthetic oligonucleotide
tgcggttgactc

SEQ ID NO: 1671 - DNA, 12 bp, Artificial Sequence
  Description of Artificial Sequence: Synthetic oligonucleotide
ctagcagtatga

SEQ ID NO: 1672 - DNA, 12 bp, Artificial Sequence
  Description of Artificial Sequence: Synthetic oligonucleotide
ctactagcggta

SEQ ID NO: 1673 - DNA, 12 bp, Artificial Sequence
  Description of Artificial Sequence: Synthetic oligonucleotide
atttgctttgcc

SEQ ID NO: 1674 - DNA, 12 bp, Artificial Sequence
  Description of Artificial Sequence: Synthetic oligonucleotide
cgcaatgaggga

SEQ ID NO: 1675 - DNA, 12 bp, Artificial Sequence
  Description of Artificial Sequence: Synthetic oligonucleotide
cgtactctcgag

SEQ ID NO: 1676 - DNA, 12 bp, Artificial Sequence
  Description of Artificial Sequence: Synthetic oligonucleotide
tgagaagaaagg

SEQ ID NO: 1677 - DNA, 12 bp, Artificial Sequence
  Description of Artificial Sequence: Synthetic oligonucleotide
gttaatggcagt

SEQ ID NO: 1678 - DNA, 12 bp, Artificial Sequence
  Description of Artificial Sequence: Synthetic oligonucleotide
tacaggacggga

SEQ ID NO: 1679 - DNA, 12 bp, Artificial Sequence
  Description of Artificial Sequence: Synthetic oligonucleotide
tactggtaagac

SEQ ID NO: 1680 - DNA, 12 bp, Artificial Sequence
  Description of Artificial Sequence: Synthetic oligonucleotide
gctacaagccct

SEQ ID NO: 1681 - DNA, 12 bp, Artificial Sequence
  Description of Artificial Sequence: Synthetic oligonucleotide
tcagttctcgtt

SEQ ID NO: 1682 - DNA, 12 bp, Artificial Sequence
  Description of Artificial Sequence: Synthetic oligonucleotide
tcggatctgtga

SEQ ID NO: 1683 - DNA, 12 bp, Artificial Sequence
  Description of Artificial Sequence: Synthetic oligonucleotide
gtatggagctat

SEQ ID NO: 1684 - DNA, 12 bp, Artificial Sequence
  Description of Artificial Sequence: Synthetic oligonucleotide
ctcaggagactt

SEQ ID NO: 1685 - DNA, 12 bp, Artificial Sequence
  Description of Artificial Sequence: Synthetic oligonucleotide
ttgagaagcact

SEQ ID NO: 1686 - DNA, 12 bp, Artificial Sequence
  Description of Artificial Sequence: Synthetic oligonucleotide
attgaagtctgg

SEQ ID NO: 1687 - DNA, 12 bp, Artificial Sequence
  Description of Artificial Sequence: Synthetic oligonucleotide
tcgtgcgtgttg

SEQ ID NO: 1688 - DNA, 12 bp, Artificial Sequence
  Description of Artificial Sequence: Synthetic oligonucleotide
gccggtactcta

SEQ ID NO: 1689 - DNA, 12 bp, Artificial Sequence
  Description of Artificial Sequence: Synthetic oligonucleotide
ccttctgtatac

SEQ ID NO: 1690 - DNA, 12 bp, Artificial Sequence
  Description of Artificial Sequence: Synthetic oligonucleotide
tcgttgggacta

SEQ ID NO: 1691 - DNA, 12 bp, Artificial Sequence
  Description of Artificial Sequence: Synthetic oligonucleotide
ataacggtgtac

SEQ ID NO: 1692 - DNA, 12 bp, Artificial Sequence
  Description of Artificial Sequence: Synthetic oligonucleotide
ggattacgctgt

SEQ ID NO: 1693 - DNA, 12 bp, Artificial Sequence
  Description of Artificial Sequence: Synthetic oligonucleotide
gttatcgcatgg

SEQ ID NO: 1694 - DNA, 12 bp, Artificial Sequence
  Description of Artificial Sequence: Synthetic oligonucleotide
cacaggattacc

SEQ ID NO: 1695 - DNA, 12 bp, Artificial Sequence
  Description of Artificial Sequence: Synthetic oligonucleotide
acgctgtcggtt

SEQ ID NO: 1696 - DNA, 12 bp, Artificial Sequence
  Description of Artificial Sequence: Synthetic oligonucleotide
gtccatggttcg

SEQ ID NO: 1697 - DNA, 12 bp, Artificial Sequence
  Description of Artificial Sequence: Synthetic oligonucleotide
tcccgtagcatg

SEQ ID NO: 1698 - DNA, 12 bp, Artificial Sequence
  Description of Artificial Sequence: Synthetic oligonucleotide
cagcagtcttcg

SEQ ID NO: 1699 - DNA, 12 bp, Artificial Sequence
  Description of Artificial Sequence: Synthetic oligonucleotide
gatcacgagagg

SEQ ID NO: 1700 - DNA, 12 bp, Artificial Sequence
  Description of Artificial Sequence: Synthetic oligonucleotide
cgatatcagtag

SEQ ID NO: 1701 - DNA, 12 bp, Artificial Sequence
  Description of Artificial Sequence: Synthetic oligonucleotide
ctcgtttcagtt

SEQ ID NO: 1702 - DNA, 12 bp, Artificial Sequence
  Description of Artificial Sequence: Synthetic oligonucleotide
tggcatgttggt

SEQ ID NO: 1703 - DNA, 12 bp, Artificial Sequence
  Description of Artificial Sequence: Synthetic oligonucleotide
cagatgtcgcta

SEQ ID NO: 1704 - DNA, 12 bp, Artificial Sequence
  Description of Artificial Sequence: Synthetic oligonucleotide
cgtagccaacat

SEQ ID NO: 1705 - DNA, 12 bp, Artificial Sequence
  Description of Artificial Sequence: Synthetic oligonucleotide
gtaaattcaggc

SEQ ID NO: 1706 - DNA, 12 bp, Artificial Sequence
  Description of Artificial Sequence: Synthetic oligonucleotide
cataagggaggc

SEQ ID NO: 1707 - DNA, 12 bp, Artificial Sequence
  Description of Artificial Sequence: Synthetic oligonucleotide
gcgaacctatac

SEQ ID NO: 1708 - DNA, 12 bp, Artificial Sequence
  Description of Artificial Sequence: Synthetic oligonucleotide
aatcgtaaggtc

SEQ ID NO: 1709 - DNA, 12 bp, Artificial Sequence
  Description of Artificial Sequence: Synthetic oligonucleotide
tgagcaacatac

SEQ ID NO: 1710 - DNA, 12 bp, Artificial Sequence
  Description of Artificial Sequence: Synthetic oligonucleotide
atacagcatacg

SEQ ID NO: 1711 - DNA, 12 bp, Artificial Sequence
  Description of Artificial Sequence: Synthetic oligonucleotide
agtgtttcggac

SEQ ID NO: 1712 - DNA, 12 bp, Artificial Sequence
  Description of Artificial Sequence: Synthetic oligonucleotide
tgtgttactcct

SEQ ID NO: 1713 - DNA, 12 bp, Artificial Sequence
  Description of Artificial Sequence: Synthetic oligonucleotide
ctctcatatgct

SEQ ID NO: 1714 - DNA, 12 bp, Artificial Sequence
  Description of Artificial Sequence: Synthetic oligonucleotide
cttacgagtaga

SEQ ID NO: 1715 - DNA, 12 bp, Artificial Sequence
  Description of Artificial Sequence: Synthetic oligonucleotide
ggttcatgaaca

SEQ ID NO: 1716 - DNA, 12 bp, Artificial Sequence
  Description of Artificial Sequence: Synthetic oligonucleotide
ctgagtgagtat

SEQ ID NO: 1717 - DNA, 12 bp, Artificial Sequence
  Description of Artificial Sequence: Synthetic oligonucleotide
acacgcggttta

SEQ ID NO: 1718 - DNA, 12 bp, Artificial Sequence
  Description of Artificial Sequence: Synthetic oligonucleotide
ggtacctgcaat

SEQ ID NO: 1719 - DNA, 12 bp, Artificial Sequence
  Description of Artificial Sequence: Synthetic oligonucleotide
ccagtatcgcgt

SEQ ID NO: 1720 - DNA, 12 bp, Artificial Sequence
  Description of Artificial Sequence: Synthetic oligonucleotide
caactgtcagac

SEQ ID NO: 1721 - DNA, 12 bp, Artificial Sequence
  Description of Artificial Sequence: Synthetic oligonucleotide
gagcgagttagg

SEQ ID NO: 1722 - DNA, 12 bp, Artificial Sequence
  Description of Artificial Sequence: Synthetic oligonucleotide
gcttgtaccgac

SEQ ID NO: 1723 - DNA, 12 bp, Artificial Sequence
  Description of Artificial Sequence: Synthetic oligonucleotide
tggcaaatctag

SEQ ID NO: 1724 - DNA, 12 bp, Artificial Sequence
  Description of Artificial Sequence: Synthetic oligonucleotide
tcgcctataagg

SEQ ID NO: 1725 - DNA, 12 bp, Artificial Sequence
  Description of Artificial Sequence: Synthetic oligonucleotide
tcgtttcttcag

SEQ ID NO: 1726 - DNA, 12 bp, Artificial Sequence
  Description of Artificial Sequence: Synthetic oligonucleotide
tgactgcgttag

SEQ ID NO: 1727 - DNA, 12 bp, Artificial Sequence
  Description of Artificial Sequence: Synthetic oligonucleotide
gctcaatcagaa

SEQ ID NO: 1728 - DNA, 12 bp, Artificial Sequence
  Description of Artificial Sequence: Synthetic oligonucleotide
cgctaggatgtt

SEQ ID NO: 1729 - DNA, 12 bp, Artificial Sequence
  Description of Artificial Sequence: Synthetic oligonucleotide
caccttacctta

SEQ ID NO: 1730 - DNA, 12 bp, Artificial Sequence
  Description of Artificial Sequence: Synthetic oligonucleotide
agtggcactatc

SEQ ID NO: 1731 - DNA, 12 bp, Artificial Sequence
  Description of Artificial Sequence: Synthetic oligonucleotide
agtacctaagtg

SEQ ID NO: 1732 - DNA, 12 bp, Artificial Sequence
  Description of Artificial Sequence: Synthetic oligonucleotide
ggctgatgtcat

SEQ ID NO: 1733 - DNA, 12 bp, Artificial Sequence
  Description of Artificial Sequence: Synthetic oligonucleotide
gaccatgtagta

SEQ ID NO: 1734 - DNA, 12 bp, Artificial Sequence
  Description of Artificial Sequence: Synthetic oligonucleotide
ggacaagtgcga

SEQ ID NO: 1735 - DNA, 12 bp, Artificial Sequence
  Description of Artificial Sequence: Synthetic oligonucleotide
ttaaccttcctg

SEQ ID NO: 1736 - DNA, 12 bp, Artificial Sequence
  Description of Artificial Sequence: Synthetic oligonucleotide
taacccgataga

SEQ ID NO: 1737 - DNA, 12 bp, Artificial Sequence
  Description of Artificial Sequence: Synthetic oligonucleotide
ggatgcaggatg

SEQ ID NO: 1738 - DNA, 12 bp, Artificial Sequence
  Description of Artificial Sequence: Synthetic oligonucleotide
tgtccagttcgg

SEQ ID NO: 1739 - DNA, 12 bp, Artificial Sequence
  Description of Artificial Sequence: Synthetic oligonucleotide
cacacgcctgat

SEQ ID NO: 1740 - DNA, 12 bp, Artificial Sequence
  Description of Artificial Sequence: Synthetic oligonucleotide
gttcgtatacgg

SEQ ID NO: 1741 - DNA, 12 bp, Artificial Sequence
  Description of Artificial Sequence: Synthetic oligonucleotide
tgccgtatgcca

SEQ ID NO: 1742 - DNA, 12 bp, Artificial Sequence
  Description of Artificial Sequence: Synthetic oligonucleotide
gtgtgctaacgt

SEQ ID NO: 1743 - DNA, 12 bp, Artificial Sequence
  Description of Artificial Sequence: Synthetic oligonucleotide
ccacttgagagt

SEQ ID NO: 1744 - DNA, 12 bp, Artificial Sequence
  Description of Artificial Sequence: Synthetic oligonucleotide
actcgtgatagc

SEQ ID NO: 1745 - DNA, 12 bp, Artificial Sequence
  Description of Artificial Sequence: Synthetic oligonucleotide
tcttcgcagcag

SEQ ID NO: 1746 - DNA, 12 bp, Artificial Sequence
  Description of Artificial Sequence: Synthetic oligonucleotide
cgggtagggtaa

SEQ ID NO: 1747 - DNA, 12 bp, Artificial Sequence
  Description of Artificial Sequence: Synthetic oligonucleotide
cgtgacaatagt

SEQ ID NO: 1748 - DNA, 12 bp, Artificial Sequence
  Description of Artificial Sequence: Synthetic oligonucleotide
cttgcggcaatc

SEQ ID NO: 1749 - DNA, 12 bp, Artificial Sequence
  Description of Artificial Sequence: Synthetic oligonucleotide
gcacttcatttc

SEQ ID NO: 1750 - DNA, 12 bp, Artificial Sequence
  Description of Artificial Sequence: Synthetic oligonucleotide
gccctcaaatgc

SEQ ID NO: 1751 - DNA, 12 bp, Artificial Sequence
  Description of Artificial Sequence: Synthetic oligonucleotide
tctcatgtggag

SEQ ID NO: 1752 - DNA, 12 bp, Artificial Sequence
  Description of Artificial Sequence: Synthetic oligonucleotide
atgcgcccgtat

SEQ ID NO: 1753 - DNA, 12 bp, Artificial Sequence
  Description of Artificial Sequence: Synthetic oligonucleotide
cgctacaactcg

SEQ ID NO: 1754 - DNA, 12 bp, Artificial Sequence
  Description of Artificial Sequence: Synthetic oligonucleotide
tgaggtttgatg

SEQ ID NO: 1755 - DNA, 12 bp, Artificial Sequence
  Description of Artificial Sequence: Synthetic oligonucleotide
agaatccaccac

SEQ ID NO: 1756 - DNA, 12 bp, Artificial Sequence
  Description of Artificial Sequence: Synthetic oligonucleotide
taaatcacgcgc

SEQ ID NO: 1757 - DNA, 12 bp, Artificial Sequence
  Description of Artificial Sequence: Synthetic oligonucleotide
ttccatcatgtc

SEQ ID NO: 1758 - DNA, 12 bp, Artificial Sequence
  Description of Artificial Sequence: Synthetic oligonucleotide
ctgtcgtgtcag

SEQ ID NO: 1759 - DNA, 12 bp, Artificial Sequence
  Description of Artificial Sequence: Synthetic oligonucleotide
ttaagacagtcg

SEQ ID NO: 1760 - DNA, 12 bp, Artificial Sequence
  Description of Artificial Sequence: Synthetic oligonucleotide
attgctggtcga

SEQ ID NO: 1761 - DNA, 12 bp, Artificial Sequence
  Description of Artificial Sequence: Synthetic oligonucleotide
ctcaagtcaaag

SEQ ID NO: 1762 - DNA, 12 bp, Artificial Sequence
  Description of Artificial Sequence: Synthetic oligonucleotide
ggcgtgcattat

SEQ ID NO: 1763 - DNA, 12 bp, Artificial Sequence
  Description of Artificial Sequence: Synthetic oligonucleotide
gtcctacacagc

SEQ ID NO: 1764 - DNA, 12 bp, Artificial Sequence
  Description of Artificial Sequence: Synthetic oligonucleotide
acggtgaaagcg

SEQ ID NO: 1765 - DNA, 12 bp, Artificial Sequence
  Description of Artificial Sequence: Synthetic oligonucleotide
tctgcactgagc

SEQ ID NO: 1766 - DNA, 12 bp, Artificial Sequence
  Description of Artificial Sequence: Synthetic oligonucleotide
aagaagccggac

SEQ ID NO: 1767 - DNA, 12 bp, Artificial Sequence
  Description of Artificial Sequence: Synthetic oligonucleotide
gtacctagcctg

SEQ ID NO: 1768 - DNA, 12 bp, Artificial Sequence
  Description of Artificial Sequence: Synthetic oligonucleotide
ggtcaatattgg

SEQ ID NO: 1769 - DNA, 12 bp, Artificial Sequence
  Description of Artificial Sequence: Synthetic oligonucleotide
gaggtgggagtt

SEQ ID NO: 1770 - DNA, 12 bp, Artificial Sequence
  Description of Artificial Sequence: Synthetic oligonucleotide
tcacgtattctc

SEQ ID NO: 1771 - DNA, 12 bp, Artificial Sequence
  Description of Artificial Sequence: Synthetic oligonucleotide
cgcagattagta

SEQ ID NO: 1772 - DNA, 12 bp, Artificial Sequence
  Description of Artificial Sequence: Synthetic oligonucleotide
acgggatacagg

SEQ ID NO: 1773 - DNA, 12 bp, Artificial Sequence
  Description of Artificial Sequence: Synthetic oligonucleotide
cactgagtacgt

SEQ ID NO: 1774 - DNA, 12 bp, Artificial Sequence
  Description of Artificial Sequence: Synthetic oligonucleotide
aggttcttaggc

SEQ ID NO: 1775 - DNA, 12 bp, Artificial Sequence
  Description of Artificial Sequence: Synthetic oligonucleotide
tggcctagtcaa

SEQ ID NO: 1776 - DNA, 12 bp, Artificial Sequence
  Description of Artificial Sequence: Synthetic oligonucleotide
gaaggtgaaggt

SEQ ID NO: 1777 - DNA, 12 bp, Artificial Sequence
  Description of Artificial Sequence: Synthetic oligonucleotide
tgggtcccacat

SEQ ID NO: 1778 - DNA, 12 bp, Artificial Sequence
  Description of Artificial Sequence: Synthetic oligonucleotide
aagagtctctag

SEQ ID NO: 1779 - DNA, 12 bp, Artificial Sequence
  Description of Artificial Sequence: Synthetic oligonucleotide
tcaagcaatacg

SEQ ID NO: 1780 - DNA, 12 bp, Artificial Sequence
  Description of Artificial Sequence: Synthetic oligonucleotide
taggtgcaatca

SEQ ID NO: 1781 - DNA, 12 bp, Artificial Sequence
  Description of Artificial Sequence: Synthetic oligonucleotide
tccttccctgct

SEQ ID NO: 1782 - DNA, 12 bp, Artificial Sequence
  Description of Artificial Sequence: Synthetic oligonucleotide
cacatgggtttg

SEQ ID NO: 1783 - DNA, 12 bp, Artificial Sequence
  Description of Artificial Sequence: Synthetic oligonucleotide
cactggtgcata

SEQ ID NO: 1784 - DNA, 12 bp, Artificial Sequence
  Description of Artificial Sequence: Synthetic oligonucleotide
tccgtcatgggt

SEQ ID NO: 1785 - DNA, 12 bp, Artificial Sequence
  Description of Artificial Sequence: Synthetic oligonucleotide
catgttggaaca

SEQ ID NO: 1786 - DNA, 12 bp, Artificial Sequence
  Description of Artificial Sequence: Synthetic oligonucleotide
gtccaaagcgtt

SEQ ID NO: 1787 - DNA, 12 bp, Artificial Sequence
  Description of Artificial Sequence: Synthetic oligonucleotide
ctcactgcttct

SEQ ID NO: 1788 - DNA, 12 bp, Artificial Sequence
  Description of Artificial Sequence: Synthetic oligonucleotide
taggtaaccgat

SEQ ID NO: 1789 - DNA, 12 bp, Artificial Sequence
  Description of Artificial Sequence: Synthetic oligonucleotide
aacgtaggctct

SEQ ID NO: 1790 - DNA, 12 bp, Artificial Sequence
  Description of Artificial Sequence: Synthetic oligonucleotide
agatctatgcag

SEQ ID NO: 1791 - DNA, 12 bp, Artificial Sequence
  Description of Artificial Sequence: Synthetic oligonucleotide
atgggaccttca

SEQ ID NO: 1792 - DNA, 12 bp, Artificial Sequence
  Description of Artificial Sequence: Synthetic oligonucleotide
agatcgtgccta

SEQ ID NO: 1793 - DNA, 12 bp, Artificial Sequence
  Description of Artificial Sequence: Synthetic oligonucleotide
taggagagacag

SEQ ID NO: 1794 - DNA, 12 bp, Artificial Sequence
  Description of Artificial Sequence: Synthetic oligonucleotide
ggtcgaattgct

SEQ ID NO: 1795 - DNA, 12 bp, Artificial Sequence
  Description of Artificial Sequence: Synthetic oligonucleotide
agttgtagtccg

SEQ ID NO: 1796 - DNA, 12 bp, Artificial Sequence
  Description of Artificial Sequence: Synthetic oligonucleotide
gcacaaggcaag

SEQ ID NO: 1797 - DNA, 12 bp, Artificial Sequence
  Description of Artificial Sequence: Synthetic oligonucleotide
gctattcctcat

SEQ ID NO: 1798 - DNA, 12 bp, Artificial Sequence
  Description of Artificial Sequence: Synthetic oligonucleotide
ctcctcccttac

SEQ ID NO: 1799 - DNA, 12 bp, Artificial Sequence
  Description of Artificial Sequence: Synthetic oligonucleotide
tgttcctctcac

SEQ ID NO: 1800 - DNA, 12 bp, Artificial Sequence
  Description of Artificial Sequence: Synthetic oligonucleotide
tgtaaacaggtc

SEQ ID NO: 1801 - DNA, 12 bp, Artificial Sequence
  Description of Artificial Sequence: Synthetic oligonucleotide
tcgtcaaacccg

SEQ ID NO: 1802 - DNA, 12 bp, Artificial Sequence
  Description of Artificial Sequence: Synthetic oligonucleotide
cggcaaacactt

SEQ ID NO: 1803 - DNA, 12 bp, Artificial Sequence
  Description of Artificial Sequence: Synthetic oligonucleotide
gtctctgaaaga

SEQ ID NO: 1804 - DNA, 12 bp, Artificial Sequence
  Description of Artificial Sequence: Synthetic oligonucleotide
gagcattacatg

SEQ ID NO: 1805 - DNA, 12 bp, Artificial Sequence
  Description of Artificial Sequence: Synthetic oligonucleotide
gcgttaacccaa

SEQ ID NO: 1806 - DNA, 12 bp, Artificial Sequence
  Description of Artificial Sequence: Synthetic oligonucleotide
gttacgtggttg

SEQ ID NO: 1807 - DNA, 12 bp, Artificial Sequence
  Description of Artificial Sequence: Synthetic oligonucleotide
taatcggtgcca

SEQ ID NO: 1808 - DNA, 12 bp, Artificial Sequence
  Description of Artificial Sequence: Synthetic oligonucleotide
gcgagttcctgt

SEQ ID NO: 1809 - DNA, 12 bp, Artificial Sequence
  Description of Artificial Sequence: Synthetic oligonucleotide
gttctgcttgtt

SEQ ID NO: 1810 - DNA, 12 bp, Artificial Sequence
  Description of Artificial Sequence: Synthetic oligonucleotide
aagcacgtctca

SEQ ID NO: 1811 - DNA, 12 bp, Artificial Sequence
  Description of Artificial Sequence: Synthetic oligonucleotide
ccacacgtttgg

SEQ ID NO: 1812 - DNA, 12 bp, Artificial Sequence
  Description of Artificial Sequence: Synthetic oligonucleotide
aggatcagggaa

SEQ ID NO: 1813 - DNA, 12 bp, Artificial Sequence
  Description of Artificial Sequence: Synthetic oligonucleotide
ttgatccggtag

SEQ ID NO: 1814 - DNA, 12 bp, Artificial Sequence
  Description of Artificial Sequence: Synthetic oligonucleotide
ttccgaatcggc

SEQ ID NO: 1815 - DNA, 12 bp, Artificial Sequence
  Description of Artificial Sequence: Synthetic oligonucleotide
gtcaagacctca

SEQ ID NO: 1816 - DNA, 12 bp, Artificial Sequence
  Description of Artificial Sequence: Synthetic oligonucleotide
tagggagaccga

SEQ ID NO: 1817 - DNA, 12 bp, Artificial Sequence
  Description of Artificial Sequence: Synthetic oligonucleotide
acagcatagctc

SEQ ID NO: 1818 - DNA, 12 bp, Artificial Sequence
  Description of Artificial Sequence: Synthetic oligonucleotide
taggacgggagt

SEQ ID NO: 1819 - DNA, 12 bp, Artificial Sequence
  Description of Artificial Sequence: Synthetic oligonucleotide
cgggtgtttgct

SEQ ID NO: 1820 - DNA, 12 bp, Artificial Sequence
  Description of Artificial Sequence: Synthetic oligonucleotide
tacctagtgaga

SEQ ID NO: 1821 - DNA, 12 bp, Artificial Sequence
  Description of Artificial Sequence: Synthetic oligonucleotide
ttgttacgttcc

SEQ ID NO: 1822 - DNA, 12 bp, Artificial Sequence
  Description of Artificial Sequence: Synthetic oligonucleotide
ataagcccaatg

SEQ ID NO: 1823 - DNA, 12 bp, Artificial Sequence
  Description of Artificial Sequence: Synthetic oligonucleotide
aatgtggctcac

SEQ ID NO: 1824 - DNA, 12 bp, Artificial Sequence
  Description of Artificial Sequence: Synthetic oligonucleotide
gcaacgaacgag

SEQ ID NO: 1825 - DNA, 12 bp, Artificial Sequence
  Description of Artificial Sequence: Synthetic oligonucleotide
ttgaccgcggtt

SEQ ID NO: 1826 - DNA, 12 bp, Artificial Sequence
  Description of Artificial Sequence: Synthetic oligonucleotide
cgttctggtggt

SEQ ID NO: 1827 - DNA, 12 bp, Artificial Sequence
  Description of Artificial Sequence: Synthetic oligonucleotide
cagttcgagata

SEQ ID NO: 1828 - DNA, 12 bp, Artificial Sequence
  Description of Artificial Sequence: Synthetic oligonucleotide
acgtgccttaga

SEQ ID NO: 1829 - DNA, 12 bp, Artificial Sequence
  Description of Artificial Sequence: Synthetic oligonucleotide
gagttccattgg

SEQ ID NO: 1830 - DNA, 12 bp, Artificial Sequence
  Description of Artificial Sequence: Synthetic oligonucleotide
tgacggtttagc

SEQ ID NO: 1831 - DNA, 12 bp, Artificial Sequence
  Description of Artificial Sequence: Synthetic oligonucleotide
gtgcaaccaatc

SEQ ID NO: 1832 - DNA, 12 bp, Artificial Sequence
  Description of Artificial Sequence: Synthetic oligonucleotide
ttggtctcctct

SEQ ID NO: 1833 - DNA, 12 bp, Artificial Sequence
  Description of Artificial Sequence: Synthetic oligonucleotide
aatgtcaccaga

SEQ ID NO: 1834 - DNA, 12 bp, Artificial Sequence
  Description of Artificial Sequence: Synthetic oligonucleotide
tcctgctatcta

SEQ ID NO: 1835 - DNA, 12 bp, Artificial Sequence
  Description of Artificial Sequence: Synthetic oligonucleotide
tctgatcgaggt

SEQ ID NO: 1836 - DNA, 12 bp, Artificial Sequence
  Description of Artificial Sequence: Synthetic oligonucleotide
aagtgtggttgt

SEQ ID NO: 1837 - DNA, 12 bp, Artificial Sequence
  Description of Artificial Sequence: Synthetic oligonucleotide
gcttgagcttga

SEQ ID NO: 1838 - DNA, 12 bp, Artificial Sequence
  Description of Artificial Sequence: Synthetic oligonucleotide
ctgcatactgag

SEQ ID NO: 1839 - DNA, 12 bp, Artificial Sequence
  Description of Artificial Sequence: Synthetic oligonucleotide
cagcctgcaaat

SEQ ID NO: 1840 - DNA, 12 bp, Artificial Sequence
  Description of Artificial Sequence: Synthetic oligonucleotide
cacgaaagcagg

SEQ ID NO: 1841 - DNA, 12 bp, Artificial Sequence
  Description of Artificial Sequence: Synthetic oligonucleotide
caagtgaaggga

SEQ ID NO: 1842 - DNA, 12 bp, Artificial Sequence
  Description of Artificial Sequence: Synthetic oligonucleotide
cttcgtttcgta

SEQ ID NO: 1843 - DNA, 12 bp, Artificial Sequence
  Description of Artificial Sequence: Synthetic oligonucleotide
cgctgtggatta

SEQ ID NO: 1844 - DNA, 12 bp, Artificial Sequence
  Description of Artificial Sequence: Synthetic oligonucleotide
cagggcctttgt

SEQ ID NO: 1845 - DNA, 12 bp, Artificial Sequence
  Description of Artificial Sequence: Synthetic oligonucleotide
ttgcaagtaccg

SEQ ID NO: 1846 - DNA, 12 bp, Artificial Sequence
  Description of Artificial Sequence: Synthetic oligonucleotide
tcaagtccgcac

SEQ ID NO: 1847 - DNA, 12 bp, Artificial Sequence
  Description of Artificial Sequence: Synthetic oligonucleotide
tgcccatcaggt

SEQ ID NO: 1848 - DNA, 12 bp, Artificial Sequence
  Description of Artificial Sequence: Synthetic oligonucleotide
caccgctcacaa

SEQ ID NO: 1849 - DNA, 12 bp, Artificial Sequence
  Description of Artificial Sequence: Synthetic oligonucleotide
ctgtcagtgacc

SEQ ID NO: 1850 - DNA, 12 bp, Artificial Sequence
  Description of Artificial Sequence: Synthetic oligonucleotide
cgatgaatatcg

SEQ ID NO: 1851 - DNA, 12 bp, Artificial Sequence
  Description of Artificial Sequence: Synthetic oligonucleotide
gcttctctcact

SEQ ID NO: 1852 - DNA, 12 bp, Artificial Sequence
  Description of Artificial Sequence: Synthetic oligonucleotide
tagcacctaaag

SEQ ID NO: 1853 - DNA, 12 bp, Artificial Sequence
  Description of Artificial Sequence: Synthetic oligonucleotide
aggttgctgtaa

SEQ ID NO: 1854 - DNA, 12 bp, Artificial Sequence
  Description of Artificial Sequence: Synthetic oligonucleotide
ctgaacagttgc

SEQ ID NO: 1855 - DNA, 12 bp, Artificial Sequence
  Description of Artificial Sequence: Synthetic oligonucleotide
acgattcgagtc

SEQ ID NO: 1856 - DNA, 12 bp, Artificial Sequence
  Description of Artificial Sequence: Synthetic oligonucleotide
gtcaattagtgg

SEQ ID NO: 1857 - DNA, 12 bp, Artificial Sequence
  Description of Artificial Sequence: Synthetic oligonucleotide
cgagatagtttg

SEQ ID NO: 1858 - DNA, 12 bp, Artificial Sequence
  Description of Artificial Sequence: Synthetic oligonucleotide
gtttcttgttgc

SEQ ID NO: 1859 - DNA, 12 bp, Artificial Sequence
  Description of Artificial Sequence: Synthetic oligonucleotide
taagtactgcag

SEQ ID NO: 1860 - DNA, 12 bp, Artificial Sequence
  Description of Artificial Sequence: Synthetic oligonucleotide
cgctcttaacgg

SEQ ID NO: 1861 - DNA, 12 bp, Artificial Sequence
  Description of Artificial Sequence: Synthetic oligonucleotide
ggttcggtccat

SEQ ID NO: 1862 - DNA, 12 bp, Artificial Sequence
  Description of Artificial Sequence: Synthetic oligonucleotide
agtacgcagtct

SEQ ID NO: 1863 - DNA, 12 bp, Artificial Sequence
  Description of Artificial Sequence: Synthetic oligonucleotide
cgcgtcaaacta

SEQ ID NO: 1864 - DNA, 12 bp, Artificial Sequence
  Description of Artificial Sequence: Synthetic oligonucleotide
acctaaagctgc

SEQ ID NO: 1865 - DNA, 12 bp, Artificial Sequence
  Description of Artificial Sequence: Synthetic oligonucleotide
gccgattgtaac

SEQ ID NO: 1866 - DNA, 12 bp, Artificial Sequence
  Description of Artificial Sequence: Synthetic oligonucleotide
ggagtctcttgc

SEQ ID NO: 1867 - DNA, 12 bp, Artificial Sequence
  Description of Artificial Sequence: Synthetic oligonucleotide
ctgatccatctt

SEQ ID NO: 1868 - DNA, 12 bp, Artificial Sequence
  Description of Artificial Sequence: Synthetic oligonucleotide
agcagctattgc

SEQ ID NO: 1869 - DNA, 12 bp, Artificial Sequence
  Description of Artificial Sequence: Synthetic oligonucleotide
ttgacacacgac

SEQ ID NO: 1870 - DNA, 12 bp, Artificial Sequence
  Description of Artificial Sequence: Synthetic oligonucleotide
accacgatgcta

SEQ ID NO: 1871 - DNA, 12 bp, Artificial Sequence
  Description of Artificial Sequence: Synthetic oligonucleotide
cggtggaagcaa

SEQ ID NO: 1872 - DNA, 12 bp, Artificial Sequence
  Description of Artificial Sequence: Synthetic oligonucleotide
aagttccggcct

SEQ ID NO: 1873 - DNA, 12 bp, Artificial Sequence
  Description of Artificial Sequence: Synthetic oligonucleotide
tatgtgccggct

SEQ ID NO: 1874 - DNA, 12 bp, Artificial Sequence
  Description of Artificial Sequence: Synthetic oligonucleotide
ctcggatagatc

SEQ ID NO: 1875 - DNA, 12 bp, Artificial Sequence
  Description of Artificial Sequence: Synthetic oligonucleotide
ataaggtcgcct

SEQ ID NO: 1876 - DNA, 12 bp, Artificial Sequence
  Description of Artificial Sequence: Synthetic oligonucleotide
gcatctaaagcc

SEQ ID NO: 1877 - DNA, 12 bp, Artificial Sequence
  Description of Artificial Sequence: Synthetic oligonucleotide
gttgaagcacct

SEQ ID NO: 1878 - DNA, 12 bp, Artificial Sequence
  Description of Artificial Sequence: Synthetic oligonucleotide
gcgctgtttaag

SEQ ID NO: 1879 - DNA, 12 bp, Artificial Sequence
  Description of Artificial Sequence: Synthetic oligonucleotide
tggtcgcatcgt

SEQ ID NO: 1880 - DNA, 12 bp, Artificial Sequence
  Description of Artificial Sequence: Synthetic oligonucleotide
ttcccgaaacga

SEQ ID NO: 1881 - DNA, 12 bp, Artificial Sequence
  Description of Artificial Sequence: Synthetic oligonucleotide
ttgccctttgat

SEQ ID NO: 1882 - DNA, 12 bp, Artificial Sequence
  Description of Artificial Sequence: Synthetic oligonucleotide
cgttgacaccca

SEQ ID NO: 1883 - DNA, 12 bp, Artificial Sequence
  Description of Artificial Sequence: Synthetic oligonucleotide
tgtctttacctg

SEQ ID NO: 1884 - DNA, 12 bp, Artificial Sequence
  Description of Artificial Sequence: Synthetic oligonucleotide
gacaattccgaa

SEQ ID NO: 1885 - DNA, 12 bp, Artificial Sequence
  Description of Artificial Sequence: Synthetic oligonucleotide
tgtaagacttgg

SEQ ID NO: 1886 - DNA, 12 bp, Artificial Sequence
  Description of Artificial Sequence: Synthetic oligonucleotide
gaactttagcgc

SEQ ID NO: 1887 - DNA, 12 bp, Artificial Sequence
  Description of Artificial Sequence: Synthetic oligonucleotide
cctggaattaag

SEQ ID NO: 1888 - DNA, 12 bp, Artificial Sequence
  Description of Artificial Sequence: Synthetic oligonucleotide
cttgggttaggt

SEQ ID NO: 1889 - DNA, 12 bp, Artificial Sequence
  Description of Artificial Sequence: Synthetic oligonucleotide
ccttgttcacct

SEQ ID NO: 1890 - DNA, 12 bp, Artificial Sequence
  Description of Artificial Sequence: Synthetic oligonucleotide
aggtctcccgat

SEQ ID NO: 1891 - DNA, 12 bp, Artificial Sequence
  Description of Artificial Sequence: Synthetic oligonucleotide
cggatctagtgt

SEQ ID NO: 1892 - DNA, 12 bp, Artificial Sequence
  Description of Artificial Sequence: Synthetic oligonucleotide
tccttagaaggc

SEQ ID NO: 1893 - DNA, 12 bp, Artificial Sequence
  Description of Artificial Sequence: Synthetic oligonucleotide
tgagaccctaca

SEQ ID NO: 1894 - DNA, 12 bp, Artificial Sequence
  Description of Artificial Sequence: Synthetic oligonucleotide
ctacgtgaaatg

SEQ ID NO: 1895 - DNA, 12 bp, Artificial Sequence
  Description of Artificial Sequence: Synthetic oligonucleotide
caaccactcggt

SEQ ID NO: 1896 - DNA, 12 bp, Artificial Sequence
  Description of Artificial Sequence: Synthetic oligonucleotide
acgatggttgat

SEQ ID NO: 1897 - DNA, 12 bp, Artificial Sequence
  Description of Artificial Sequence: Synthetic oligonucleotide
cgatcttcgagc

SEQ ID NO: 1898 - DNA, 12 bp, Artificial Sequence
  Description of Artificial Sequence: Synthetic oligonucleotide
gatggacttcaa

SEQ ID NO: 1899 - DNA, 12 bp, Artificial Sequence
  Description of Artificial Sequence: Synthetic oligonucleotide
aagtatcctgcg

SEQ ID NO: 1900 - DNA, 12 bp, Artificial Sequence
  Description of Artificial Sequence: Synthetic oligonucleotide
gccagcttcatg

SEQ ID NO: 1901 - DNA, 12 bp, Artificial Sequence
  Description of Artificial Sequence: Synthetic oligonucleotide
tcttagtcgggc

SEQ ID NO: 1902 - DNA, 12 bp, Artificial Sequence
  Description of Artificial Sequence: Synthetic oligonucleotide
agacttctcagg

SEQ ID NO: 1903 - DNA, 12 bp, Artificial Sequence
  Description of Artificial Sequence: Synthetic oligonucleotide
gtcgaatttgcg

SEQ ID NO: 1904 - DNA, 12 bp, Artificial Sequence
  Description of Artificial Sequence: Synthetic oligonucleotide
tactgagcctcg

SEQ ID NO: 1905 - DNA, 12 bp, Artificial Sequence
  Description of Artificial Sequence: Synthetic oligonucleotide
caaatggtcgtc

SEQ ID NO: 1906 - DNA, 12 bp, Artificial Sequence
  Description of Artificial Sequence: Synthetic oligonucleotide
gtgcattcgcca

SEQ ID NO: 1907 - DNA, 12 bp, Artificial Sequence
  Description of Artificial Sequence: Synthetic oligonucleotide
gtaccgttgcaa

SEQ ID NO: 1908 - DNA, 12 bp, Artificial Sequence
  Description of Artificial Sequence: Synthetic oligonucleotide
ggatgtcttcgc

SEQ ID NO: 1909 - DNA, 12 bp, Artificial Sequence
  Description of Artificial Sequence: Synthetic oligonucleotide
gcatcagagtta

SEQ ID NO: 1910 - DNA, 12 bp, Artificial Sequence
  Description of Artificial Sequence: Synthetic oligonucleotide
agaaggccttat

SEQ ID NO: 1911 - DNA, 12 bp, Artificial Sequence
  Description of Artificial Sequence: Synthetic oligonucleotide
acacataagtcg

SEQ ID NO: 1912 - DNA, 12 bp, Artificial Sequence
  Description of Artificial Sequence: Synthetic oligonucleotide
tgagagtccctc

SEQ ID NO: 1913 - DNA, 12 bp, Artificial Sequence
  Description of Artificial Sequence: Synthetic oligonucleotide
ctgatagcacac

SEQ ID NO: 1914 - DNA, 12 bp, Artificial Sequence
  Description of Artificial Sequence: Synthetic oligonucleotide
tcctgaacacag

SEQ ID NO: 1915 - DNA, 12 bp, Artificial Sequence
  Description of Artificial Sequence: Synthetic oligonucleotide
gtggtcatcgta

SEQ ID NO: 1916 - DNA, 12 bp, Artificial Sequence
  Description of Artificial Sequence: Synthetic oligonucleotide
tggagccttgtc

SEQ ID NO: 1917 - DNA, 12 bp, Artificial Sequence
  Description of Artificial Sequence: Synthetic oligonucleotide
tactgccagtga

SEQ ID NO: 1918 - DNA, 12 bp, Artificial Sequence
  Description of Artificial Sequence: Synthetic oligonucleotide
ctctgtagccga

SEQ ID NO: 1919 - DNA, 12 bp, Artificial Sequence
  Description of Artificial Sequence: Synthetic oligonucleotide
acaggtagagag

SEQ ID NO: 1920 - DNA, 12 bp, Artificial Sequence
  Description of Artificial Sequence: Synthetic oligonucleotide
aagcctctacga

SEQ ID NO: 1921 - DNA, 12 bp, Artificial Sequence
  Description of Artificial Sequence: Synthetic oligonucleotide
ctgaagggcgaa

SEQ ID NO: 1922 - DNA, 12 bp, Artificial Sequence
  Description of Artificial Sequence: Synthetic oligonucleotide
ctcgatgtaagc

SEQ ID NO: 1923 - DNA, 12 bp, Artificial Sequence
  Description of Artificial Sequence: Synthetic oligonucleotide
gagtttacggtc

SEQ ID NO: 1924 - DNA, 12 bp, Artificial Sequence
  Description of Artificial Sequence: Synthetic oligonucleotide
gcagtaactgtc

SEQ ID NO: 1925 - DNA, 12 bp, Artificial Sequence
  Description of Artificial Sequence: Synthetic oligonucleotide
tgctcacgtgtg

SEQ ID NO: 1926 - DNA, 12 bp, Artificial Sequence
  Description of Artificial Sequence: Synthetic oligonucleotide
tacttgccacgg

SEQ ID NO: 1927 - DNA, 12 bp, Artificial Sequence
  Description of Artificial Sequence: Synthetic oligonucleotide
cgctcacagaat

SEQ ID NO: 1928 - DNA, 12 bp, Artificial Sequence
  Description of Artificial Sequence: Synthetic oligonucleotide
agcttcgacagt

SEQ ID NO: 1929 - DNA, 12 bp, Artificial Sequence
  Description of Artificial Sequence: Synthetic oligonucleotide
ggcacaccctta

SEQ ID NO: 1930 - DNA, 12 bp, Artificial Sequence
  Description of Artificial Sequence: Synthetic oligonucleotide
catatagcccga

SEQ ID NO: 1931 - DNA, 12 bp, Artificial Sequence
  Description of Artificial Sequence: Synthetic oligonucleotide
gtaataatgccg

SEQ ID NO: 1932 - DNA, 12 bp, Artificial Sequence
  Description of Artificial Sequence: Synthetic oligonucleotide
gcataaacgact

SEQ ID NO: 1933 - DNA, 12 bp, Artificial Sequence
  Description of Artificial Sequence: Synthetic oligonucleotide
attcggtagtgc

SEQ ID NO: 1934 - DNA, 12 bp, Artificial Sequence
  Description of Artificial Sequence: Synthetic oligonucleotide
atacgcatcaag

SEQ ID NO: 1935 - DNA, 12 bp, Artificial Sequence
  Description of Artificial Sequence: Synthetic oligonucleotide
gtccagctatga

SEQ ID NO: 1936 - DNA, 12 bp, Artificial Sequence
  Description of Artificial Sequence: Synthetic oligonucleotide
cagtgcacgtct

SEQ ID NO: 1937 - DNA, 12 bp, Artificial Sequence
  Description of Artificial Sequence: Synthetic oligonucleotide
ctcggcaccaat

SEQ ID NO: 1938 - DNA, 12 bp, Artificial Sequence
  Description of Artificial Sequence: Synthetic oligonucleotide
ctttgcactttg

SEQ ID NO: 1939 - DNA, 12 bp, Artificial Sequence
  Description of Artificial Sequence: Synthetic oligonucleotide
cgagctgttacc

SEQ ID NO: 1940 - DNA, 12 bp, Artificial Sequence
  Description of Artificial Sequence: Synthetic oligonucleotide
agatgtccgtca

SEQ ID NO: 1941 - DNA, 12 bp, Artificial Sequence
  Description of Artificial Sequence: Synthetic oligonucleotide
tcgcgcaactgt

SEQ ID NO: 1942 - DNA, 12 bp, Artificial Sequence
  Description of Artificial Sequence: Synthetic oligonucleotide
caagactgacct

SEQ ID NO: 1943 - DNA, 12 bp, Artificial Sequence
  Description of Artificial Sequence: Synthetic oligonucleotide
actcgaaaccaa

SEQ ID NO: 1944 - DNA, 12 bp, Artificial Sequence
  Description of Artificial Sequence: Synthetic oligonucleotide
tgacacgacatc

SEQ ID NO: 1945 - DNA, 12 bp, Artificial Sequence
  Description of Artificial Sequence: Synthetic oligonucleotide
caacacatgctg

SEQ ID NO: 1946 - DNA, 12 bp, Artificial Sequence
  Description of Artificial Sequence: Synthetic oligonucleotide
gcacctgttgaa

SEQ ID NO: 1947 - DNA, 12 bp, Artificial Sequence
  Description of Artificial Sequence: Synthetic oligonucleotide
attcctctccac

SEQ ID NO: 1948 - DNA, 12 bp, Artificial Sequence
  Description of Artificial Sequence: Synthetic oligonucleotide
ccgataaaggtt

SEQ ID NO: 1949 - DNA, 12 bp, Artificial Sequence
  Description of Artificial Sequence: Synthetic oligonucleotide
accgtaagacat

SEQ ID NO: 1950 - DNA, 12 bp, Artificial Sequence
  Description of Artificial Sequence: Synthetic oligonucleotide
tgttgacgatgc

SEQ ID NO: 1951 - DNA, 12 bp, Artificial Sequence
  Description of Artificial Sequence: Synthetic oligonucleotide
attctctcacgt

SEQ ID NO: 1952 - DNA, 12 bp, Artificial Sequence
  Description of Artificial Sequence: Synthetic oligonucleotide
cctagagaaact

SEQ ID NO: 1953 - DNA, 12 bp, Artificial Sequence
  Description of Artificial Sequence: Synthetic oligonucleotide
tggttcatcctt

SEQ ID NO: 1954 - DNA, 12 bp, Artificial Sequence
  Description of Artificial Sequence: Synthetic oligonucleotide
ctttgtcagggc

SEQ ID NO: 1955 - DNA, 12 bp, Artificial Sequence
  Description of Artificial Sequence: Synthetic oligonucleotide
atcacgggagag

SEQ ID NO: 1956 - DNA, 12 bp, Artificial Sequence
  Description of Artificial Sequence: Synthetic oligonucleotide
gacaagaaggtg

SEQ ID NO: 1957 - DNA, 12 bp, Artificial Sequence
  Description of Artificial Sequence: Synthetic oligonucleotide
cgactctaaacg

SEQ ID NO: 1958 - DNA, 12 bp, Artificial Sequence
  Description of Artificial Sequence: Synthetic oligonucleotide
gaggttcttgac

SEQ ID NO: 1959 - DNA, 12 bp, Artificial Sequence
  Description of Artificial Sequence: Synthetic oligonucleotide
agcactttgaga

SEQ ID NO: 1960 - DNA, 12 bp, Artificial Sequence
  Description of Artificial Sequence: Synthetic oligonucleotide
tccgaagacaat

SEQ ID NO: 1961 - DNA, 12 bp, Artificial Sequence
  Description of Artificial Sequence: Synthetic oligonucleotide
tcactgctagga

SEQ ID NO: 1962 - DNA, 12 bp, Artificial Sequence
  Description of Artificial Sequence: Synthetic oligonucleotide
gagtgctctaac

SEQ ID NO: 1963 - DNA, 12 bp, Artificial Sequence
  Description of Artificial Sequence: Synthetic oligonucleotide
gtcttcagcaag

SEQ ID NO: 1964 - DNA, 12 bp, Artificial Sequence
  Description of Artificial Sequence: Synthetic oligonucleotide
ctgtaaaggttg

SEQ ID NO: 1965 - DNA, 12 bp, Artificial Sequence
  Description of Artificial Sequence: Synthetic oligonucleotide
ccacggtacttg

SEQ ID NO: 1966 - DNA, 12 bp, Artificial Sequence
  Description of Artificial Sequence: Synthetic oligonucleotide
acttcggatgca

SEQ ID NO: 1967 - DNA, 12 bp, Artificial Sequence
  Description of Artificial Sequence: Synthetic oligonucleotide
ctaatcagagtg

SEQ ID NO: 1968 - DNA, 12 bp, Artificial Sequence
  Description of Artificial Sequence: Synthetic oligonucleotide
ttgtgtctccct

SEQ ID NO: 1969 - DNA, 12 bp, Artificial Sequence
  Description of Artificial Sequence: Synthetic oligonucleotide
cggataacctcc

SEQ ID NO: 1970 - DNA, 12 bp, Artificial Sequence
  Description of Artificial Sequence: Synthetic oligonucleotide
tgagtcattgag

SEQ ID NO: 1971 - DNA, 12 bp, Artificial Sequence
  Description of Artificial Sequence: Synthetic oligonucleotide
actagttggacc

SEQ ID NO: 1972 - DNA, 12 bp, Artificial Sequence
  Description of Artificial Sequence: Synthetic oligonucleotide
taacatcaggca

SEQ ID NO: 1973 - DNA, 12 bp, Artificial Sequence
  Description of Artificial Sequence: Synthetic oligonucleotide
ttggcattggca

SEQ ID NO: 1974 - DNA, 12 bp, Artificial Sequence
  Description of Artificial Sequence: Synthetic oligonucleotide
cgttaccggact

SEQ ID NO: 1975 - DNA, 12 bp, Artificial Sequence
  Description of Artificial Sequence: Synthetic oligonucleotide
agggtgacttta

SEQ ID NO: 1976 - DNA, 12 bp, Artificial Sequence
  Description of Artificial Sequence: Synthetic oligonucleotide
tacggcagttca

SEQ ID NO: 1977 - DNA, 12 bp, Artificial Sequence
  Description of Artificial Sequence: Synthetic oligonucleotide
gatcaacccaca

SEQ ID NO: 1978 - DNA, 12 bp, Artificial Sequence
  Description of Artificial Sequence: Synthetic oligonucleotide
taatgagatgcc

SEQ ID NO: 1979 - DNA, 12 bp, Artificial Sequence
  Description of Artificial Sequence: Synthetic oligonucleotide
tataatccgagg

SEQ ID NO: 1980 - DNA, 12 bp, Artificial Sequence
  Description of Artificial Sequence: Synthetic oligonucleotide
tgtgcacgccat

SEQ ID NO: 1981 - DNA, 12 bp, Artificial Sequence
  Description of Artificial Sequence: Synthetic oligonucleotide
gacttcatgcga

SEQ ID NO: 1982 - DNA, 12 bp, Artificial Sequence
  Description of Artificial Sequence: Synthetic oligonucleotide
ctctagaagagt

SEQ ID NO: 1983 - DNA, 12 bp, Artificial Sequence
  Description of Artificial Sequence: Synthetic oligonucleotide
atgcgagacttc

SEQ ID NO: 1984 - DNA, 12 bp, Artificial Sequence
  Description of Artificial Sequence: Synthetic oligonucleotide
atcggtggaatt

SEQ ID NO: 1985 - DNA, 12 bp, Artificial Sequence
  Description of Artificial Sequence: Synthetic oligonucleotide
tccagatagcgt

SEQ ID NO: 1986 - DNA, 12 bp, Artificial Sequence
  Description of Artificial Sequence: Synthetic oligonucleotide
tcccagaagctc

SEQ ID NO: 1987 - DNA, 12 bp, Artificial Sequence
  Description of Artificial Sequence: Synthetic oligonucleotide
gcctgtctgcaa

SEQ ID NO: 1988 - DNA, 12 bp, Artificial Sequence
  Description of Artificial Sequence: Synthetic oligonucleotide
tgcacagtcgct

SEQ ID NO: 1989 - DNA, 12 bp, Artificial Sequence
  Description of Artificial Sequence: Synthetic oligonucleotide
cgcttgtgtagc

SEQ ID NO: 1990 - DNA, 12 bp, Artificial Sequence
  Description of Artificial Sequence: Synthetic oligonucleotide
tatagtgggcct

SEQ ID NO: 1991 - DNA, 12 bp, Artificial Sequence
  Description of Artificial Sequence: Synthetic oligonucleotide
aatccggtcacc

SEQ ID NO: 1992 - DNA, 12 bp, Artificial Sequence
  Description of Artificial Sequence: Synthetic oligonucleotide
acgctagattga

SEQ ID NO: 1993 - DNA, 12 bp, Artificial Sequence
  Description of Artificial Sequence: Synthetic oligonucleotide
actgatggcctc

SEQ ID NO: 1994 - DNA, 12 bp, Artificial Sequence
  Description of Artificial Sequence: Synthetic oligonucleotide
catgcggatcct

SEQ ID NO: 1995 - DNA, 12 bp, Artificial Sequence
  Description of Artificial Sequence: Synthetic oligonucleotide
atgaatgcgtcc

SEQ ID NO: 1996 - DNA, 12 bp, Artificial Sequence
  Description of Artificial Sequence: Synthetic oligonucleotide
tcgacggagaga

SEQ ID NO: 1997 - DNA, 12 bp, Artificial Sequence
  Description of Artificial Sequence: Synthetic oligonucleotide
aagtgcttggta

SEQ ID NO: 1998 - DNA, 12 bp, Artificial Sequence
  Description of Artificial Sequence: Synthetic oligonucleotide
ttacggctggtc

SEQ ID NO: 1999 - DNA, 12 bp, Artificial Sequence
  Description of Artificial Sequence: Synthetic oligonucleotide
ttcgatgccgca

SEQ ID NO: 2000 - DNA, 12 bp, Artificial Sequence
  Description of Artificial Sequence: Synthetic oligonucleotide
tgctccgtagaa

SEQ ID NO: 2001 - DNA, 12 bp, Artificial Sequence
  Description of Artificial Sequence: Synthetic oligonucleotide
gactctgctcag

SEQ ID NO: 2002 - DNA, 12 bp, Artificial Sequence
  Description of Artificial Sequence: Synthetic oligonucleotide
atctgacatcgg

SEQ ID NO: 2003 - DNA, 12 bp, Artificial Sequence
  Description of Artificial Sequence: Synthetic oligonucleotide
ggtaaagggtcg

SEQ ID NO: 2004 - DNA, 12 bp, Artificial Sequence
  Description of Artificial Sequence: Synthetic oligonucleotide
tgcaatggtacc

SEQ ID NO: 2005 - DNA, 12 bp, Artificial Sequence
  Description of Artificial Sequence: Synthetic oligonucleotide
tgtggctcgtgt

SEQ ID NO: 2006 - DNA, 12 bp, Artificial Sequence
  Description of Artificial Sequence: Synthetic oligonucleotide
tgataggtacac

SEQ ID NO: 2007 - DNA, 12 bp, Artificial Sequence
  Description of Artificial Sequence: Synthetic oligonucleotide
cacgtacacgta

SEQ ID NO: 2008 - DNA, 12 bp, Artificial Sequence
  Description of Artificial Sequence: Synthetic oligonucleotide
gatagggccaag

SEQ ID NO: 2009 - DNA, 12 bp, Artificial Sequence
  Description of Artificial Sequence: Synthetic oligonucleotide
gctttctcaatc

SEQ ID NO: 2010 - DNA, 12 bp, Artificial Sequence
  Description of Artificial Sequence: Synthetic oligonucleotide
aacaggtctctg

SEQ ID NO: 2011 - DNA, 12 bp, Artificial Sequence
  Description of Artificial Sequence: Synthetic oligonucleotide
aactttcaggag

SEQ ID NO: 2012 - DNA, 12 bp, Artificial Sequence
  Description of Artificial Sequence: Synthetic oligonucleotide
cgagttcatcga

SEQ ID NO: 2013 - DNA, 12 bp, Artificial Sequence
  Description of Artificial Sequence: Synthetic oligonucleotide
cagagctaattg

SEQ ID NO: 2014 - DNA, 12 bp, Artificial Sequence
  Description of Artificial Sequence: Synthetic oligonucleotide
cgggcttcatca

SEQ ID NO: 2015 - DNA, 12 bp, Artificial Sequence
  Description of Artificial Sequence: Synthetic oligonucleotide
acagtgcgtcct

SEQ ID NO: 2016 - DNA, 12 bp, Artificial Sequence
  Description of Artificial Sequence: Synthetic oligonucleotide
gtgctaataggt

SEQ ID NO: 2017 - DNA, 12 bp, Artificial Sequence
  Description of Artificial Sequence: Synthetic oligonucleotide
tgcacgtgataa

SEQ ID NO: 2018 - DNA, 12 bp, Artificial Sequence
  Description of Artificial Sequence: Synthetic oligonucleotide
aagcagattgtc

SEQ ID NO: 2019 - DNA, 12 bp, Artificial Sequence
  Description of Artificial Sequence: Synthetic oligonucleotide
ttatccagtcct

SEQ ID NO: 2020 - DNA, 12 bp, Artificial Sequence
  Description of Artificial Sequence: Synthetic oligonucleotide
cgtaacgtaatg

SEQ ID NO: 2021 - DNA, 12 bp, Artificial Sequence
  Description of Artificial Sequence: Synthetic oligonucleotide
taggaactcacc

SEQ ID NO: 2022 - DNA, 12 bp, Artificial Sequence
  Description of Artificial Sequence: Synthetic oligonucleotide
gcgatcacacct

SEQ ID NO: 2023 - DNA, 12 bp, Artificial Sequence
  Description of Artificial Sequence: Synthetic oligonucleotide
gttcggtgtcca

SEQ ID NO: 2024 - DNA, 12 bp, Artificial Sequence
  Description of Artificial Sequence: Synthetic oligonucleotide
tagaggcgtagg

SEQ ID NO: 2025 - DNA, 12 bp, Artificial Sequence
  Description of Artificial Sequence: Synthetic oligonucleotide
ctaagacgtcgt

SEQ ID NO: 2026 - DNA, 12 bp, Artificial Sequence
  Description of Artificial Sequence: Synthetic oligonucleotide
tagcgacctcac

SEQ ID NO: 2027 - DNA, 12 bp, Artificial Sequence
  Description of Artificial Sequence: Synthetic oligonucleotide
tgtattggacag

SEQ ID NO: 2028 - DNA, 12 bp, Artificial Sequence
  Description of Artificial Sequence: Synthetic oligonucleotide
aatggaccgttc

SEQ ID NO: 2029 - DNA, 12 bp, Artificial Sequence
  Description of Artificial Sequence: Synthetic oligonucleotide
aagacagctatc

SEQ ID NO: 2030 - DNA, 12 bp, Artificial Sequence
  Description of Artificial Sequence: Synthetic oligonucleotide
tcagcgccgtta

SEQ ID NO: 2031 - DNA, 12 bp, Artificial Sequence
  Description of Artificial Sequence: Synthetic oligonucleotide
ggctcagattcc

SEQ ID NO: 2032 - DNA, 12 bp, Artificial Sequence
  Description of Artificial Sequence: Synthetic oligonucleotide
accctgggtatc

SEQ ID NO: 2033 - DNA, 12 bp, Artificial Sequence
  Description of Artificial Sequence: Synthetic oligonucleotide
agaaagggtgtg

SEQ ID NO: 2034 - DNA, 12 bp, Artificial Sequence
  Description of Artificial Sequence: Synthetic oligonucleotide
gtacgtcactga

SEQ ID NO: 2035 - DNA, 12 bp, Artificial Sequence
  Description of Artificial Sequence: Synthetic oligonucleotide
attgaccggtca

SEQ ID NO: 2036 - DNA, 12 bp, Artificial Sequence
  Description of Artificial Sequence: Synthetic oligonucleotide
tagaccgactcc

SEQ ID NO: 2037 - DNA, 12 bp, Artificial Sequence
  Description of Artificial Sequence: Synthetic oligonucleotide
cttggtagtgcc

SEQ ID NO: 2038 - DNA, 12 bp, Artificial Sequence
  Description of Artificial Sequence: Synthetic oligonucleotide
agcgagaagtga

SEQ ID NO: 2039 - DNA, 12 bp, Artificial Sequence
  Description of Artificial Sequence: Synthetic oligonucleotide
gctcacaatgtg

SEQ ID NO: 2040 - DNA, 12 bp, Artificial Sequence
  Description of Artificial Sequence: Synthetic oligonucleotide
tagcctgtcgtg

SEQ ID NO: 2041 - DNA, 12 bp, Artificial Sequence
  Description of Artificial Sequence: Synthetic oligonucleotide
ttctccatcaca

SEQ ID NO: 2042 - DNA, 12 bp, Artificial Sequence
  Description of Artificial Sequence: Synthetic oligonucleotide
gtcaacgctgtc

SEQ ID NO: 2043 - DNA, 12 bp, Artificial Sequence
  Description of Artificial Sequence: Synthetic oligonucleotide
gtgctgcgctta

SEQ ID NO: 2044 - DNA, 12 bp, Artificial Sequence
  Description of Artificial Sequence: Synthetic oligonucleotide
cttcaagatgga

SEQ ID NO: 2045 - DNA, 12 bp, Artificial Sequence
  Description of Artificial Sequence: Synthetic oligonucleotide
tattgcagcagc

SEQ ID NO: 2046 - DNA, 12 bp, Artificial Sequence
  Description of Artificial Sequence: Synthetic oligonucleotide
acagacgacgga

SEQ ID NO: 2047 - DNA, 12 bp, Artificial Sequence
  Description of Artificial Sequence: Synthetic oligonucleotide
cgtaggtagagg

SEQ ID NO: 2048 - DNA, 12 bp, Artificial Sequence
  Description of Artificial Sequence: Synthetic oligonucleotide
acaggagggtgt

SEQ ID NO: 2049 - DNA, 12 bp, Artificial Sequence
  Description of Artificial Sequence: Synthetic oligonucleotide
agtaggaggcac

SEQ ID NO: 2050 - DNA, 12 bp, Artificial Sequence
  Description of Artificial Sequence: Synthetic oligonucleotide
gctgcgtatacc

SEQ ID NO: 2051 - DNA, 12 bp, Artificial Sequence
  Description of Artificial Sequence: Synthetic oligonucleotide
agattcgctcga

SEQ ID NO: 2052 - DNA, 12 bp, Artificial Sequence
  Description of Artificial Sequence: Synthetic oligonucleotide
tctatgcgaacg

SEQ ID NO: 2053 - DNA, 12 bp, Artificial Sequence
  Description of Artificial Sequence: Synthetic oligonucleotide
atttaggacgac

SEQ ID NO: 2054 - DNA, 12 bp, Artificial Sequence
  Description of Artificial Sequence: Synthetic oligonucleotide
gctgtcgtcaac

SEQ ID NO: 2055 - DNA, 12 bp, Artificial Sequence
  Description of Artificial Sequence: Synthetic oligonucleotide
acccggatttcg

SEQ ID NO: 2056 - DNA, 12 bp, Artificial Sequence
  Description of Artificial Sequence: Synthetic oligonucleotide
acaaggcaaggc

SEQ ID NO: 2057 - DNA, 12 bp, Artificial Sequence
  Description of Artificial Sequence: Synthetic oligonucleotide
agccggagagta

SEQ ID NO: 2058 - DNA, 12 bp, Artificial Sequence
  Description of Artificial Sequence: Synthetic oligonucleotide
ctatgagtccag

SEQ ID NO: 2059 - DNA, 12 bp, Artificial Sequence
  Description of Artificial Sequence: Synthetic oligonucleotide
ggatagccaagg

SEQ ID NO: 2060 - DNA, 12 bp, Artificial Sequence
  Description of Artificial Sequence: Synthetic oligonucleotide
atagaggccatt

SEQ ID NO: 2061 - DNA, 12 bp, Artificial Sequence
  Description of Artificial Sequence: Synthetic oligonucleotide
cgtccgtatgaa

SEQ ID NO: 2062 - DNA, 12 bp, Artificial Sequence
  Description of Artificial Sequence: Synthetic oligonucleotide
cgttagtgactg

SEQ ID NO: 2063 - DNA, 12 bp, Artificial Sequence
  Description of Artificial Sequence: Synthetic oligonucleotide
cctgtaggttgc

SEQ ID NO: 2064 - DNA, 12 bp, Artificial Sequence
  Description of Artificial Sequence: Synthetic oligonucleotide
agtcctttatcc

SEQ ID NO: 2065 - DNA, 12 bp, Artificial Sequence
  Description of Artificial Sequence: Synthetic oligonucleotide
tggttggttacg

SEQ ID NO: 2066 - DNA, 12 bp, Artificial Sequence
  Description of Artificial Sequence: Synthetic oligonucleotide
aagcttgaaacc

SEQ ID NO: 2067 - DNA, 12 bp, Artificial Sequence
  Description of Artificial Sequence: Synthetic oligonucleotide
cgattaggaatc

SEQ ID NO: 2068 - DNA, 12 bp, Artificial Sequence
  Description of Artificial Sequence: Synthetic oligonucleotide
gccgttgatgct

SEQ ID NO: 2069 - DNA, 12 bp, Artificial Sequence
  Description of Artificial Sequence: Synthetic oligonucleotide
aaggcctttacg

SEQ ID NO: 2070 - DNA, 12 bp, Artificial Sequence
  Description of Artificial Sequence: Synthetic oligonucleotide
agtttgcgagat

SEQ ID NO: 2071 - DNA, 12 bp, Artificial Sequence
  Description of Artificial Sequence: Synthetic oligonucleotide
gtcgtccaaatg

SEQ ID NO: 2072 - DNA, 12 bp, Artificial Sequence
  Description of Artificial Sequence: Synthetic oligonucleotide
taagcgtctcga

SEQ ID NO: 2073 - DNA, 12 bp, Artificial Sequence
  Description of Artificial Sequence: Synthetic oligonucleotide
acgtctcagtgc

SEQ ID NO: 2074 - DNA, 12 bp, Artificial Sequence
  Description of Artificial Sequence: Synthetic oligonucleotide
ttcaacctttcg

SEQ ID NO: 2075 - DNA, 12 bp, Artificial Sequence
  Description of Artificial Sequence: Synthetic oligonucleotide
ctaggcaatcaa

SEQ ID NO: 2076 - DNA, 12 bp, Artificial Sequence
  Description of Artificial Sequence: Synthetic oligonucleotide
tcaacgtgctgc

SEQ ID NO: 2077 - DNA, 12 bp, Artificial Sequence
  Description of Artificial Sequence: Synthetic oligonucleotide
caacgtgctcca

SEQ ID NO: 2078 - DNA, 12 bp, Artificial Sequence
  Description of Artificial Sequence: Synthetic oligonucleotide
atagcttcgtgg

SEQ ID NO: 2079 - DNA, 12 bp, Artificial Sequence
  Description of Artificial Sequence: Synthetic oligonucleotide
tagtagcacctg

SEQ ID NO: 2080 - DNA, 12 bp, Artificial Sequence
  Description of Artificial Sequence: Synthetic oligonucleotide
tgggaggtggta

SEQ ID NO: 2081 - DNA, 12 bp, Artificial Sequence
  Description of Artificial Sequence: Synthetic oligonucleotide
aggacctcgttc

SEQ ID NO: 2082 - DNA, 12 bp, Artificial Sequence
  Description of Artificial Sequence: Synthetic oligonucleotide
gaaccagtactc

SEQ ID NO: 2083 - DNA, 12 bp, Artificial Sequence
  Description of Artificial Sequence: Synthetic oligonucleotide
tacacaagtcgc

SEQ ID NO: 2084 - DNA, 12 bp, Artificial Sequence
  Description of Artificial Sequence: Synthetic oligonucleotide
cgggatcaaatt

SEQ ID NO: 2085 - DNA, 12 bp, Artificial Sequence
  Description of Artificial Sequence: Synthetic oligonucleotide
aggtcatcttgg

SEQ ID NO: 2086 - DNA, 12 bp, Artificial Sequence
  Description of Artificial Sequence: Synthetic oligonucleotide
cgcctgccaata

SEQ ID NO: 2087 - DNA, 12 bp, Artificial Sequence
  Description of Artificial Sequence: Synthetic oligonucleotide
cttgtctggagc

SEQ ID NO: 2088 - DNA, 12 bp, Artificial Sequence
  Description of Artificial Sequence: Synthetic oligonucleotide
tgataatgcacg

SEQ ID NO: 2089 - DNA, 12 bp, Artificial Sequence
  Description of Artificial Sequence: Synthetic oligonucleotide
gcgtccatgaat

SEQ ID NO: 2090 - DNA, 12 bp, Artificial Sequence
  Description of Artificial Sequence: Synthetic oligonucleotide
agtcatcgaatg

SEQ ID NO: 2091 - DNA, 12 bp, Artificial Sequence
  Description of Artificial Sequence: Synthetic oligonucleotide
tgctgtgaccac

SEQ ID NO: 2092 - DNA, 12 bp, Artificial Sequence
  Description of Artificial Sequence: Synthetic oligonucleotide
ttgagcttgagc

SEQ ID NO: 2093 - DNA, 12 bp, Artificial Sequence
  Description of Artificial Sequence: Synthetic oligonucleotide
accgcatcaatg

SEQ ID NO: 2094 - DNA, 12 bp, Artificial Sequence
  Description of Artificial Sequence: Synthetic oligonucleotide
tagtgatgacca

SEQ ID NO: 2095 - DNA, 12 bp, Artificial Sequence
  Description of Artificial Sequence: Synthetic oligonucleotide
gtaatgcgtaac

SEQ ID NO: 2096 - DNA, 12 bp, Artificial Sequence
  Description of Artificial Sequence: Synthetic oligonucleotide
atcttggagtcg

SEQ ID NO: 2097 - DNA, 12 bp, Artificial Sequence
  Description of Artificial Sequence: Synthetic oligonucleotide
acacttcggcaa

SEQ ID NO: 2098 - DNA, 12 bp, Artificial Sequence
  Description of Artificial Sequence: Synthetic oligonucleotide
tactaacgcggt

SEQ ID NO: 2099 - DNA, 12 bp, Artificial Sequence
  Description of Artificial Sequence: Synthetic oligonucleotide
aaggtcaatcgt

SEQ ID NO: 2100 - DNA, 12 bp, Artificial Sequence
  Description of Artificial Sequence: Synthetic oligonucleotide
acagccacccat

SEQ ID NO: 2101 - DNA, 12 bp, Artificial Sequence
  Description of Artificial Sequence: Synthetic oligonucleotide
gtcgccgtacat

SEQ ID NO: 2102 - DNA, 12 bp, Artificial Sequence
  Description of Artificial Sequence: Synthetic oligonucleotide
agcaccggtctt

SEQ ID NO: 2103 - DNA, 12 bp, Artificial Sequence
  Description of Artificial Sequence: Synthetic oligonucleotide
acctcccggata

SEQ ID NO: 2104 - DNA, 12 bp, Artificial Sequence
  Description of Artificial Sequence: Synthetic oligonucleotide
atccgcagtcac

SEQ ID NO: 2105 - DNA, 12 bp, Artificial Sequence
  Description of Artificial Sequence: Synthetic oligonucleotide
acctacttgtct

SEQ ID NO: 2106 - DNA, 12 bp, Artificial Sequence
  Description of Artificial Sequence: Synthetic oligonucleotide
tatgttgacggc

SEQ ID NO: 2107 - DNA, 12 bp, Artificial Sequence
  Description of Artificial Sequence: Synthetic oligonucleotide
ggaatccgatta

SEQ ID NO: 2108 - DNA, 12 bp, Artificial Sequence
  Description of Artificial Sequence: Synthetic oligonucleotide
gcaaatcagcct

SEQ ID NO: 2109 - DNA, 12 bp, Artificial Sequence
  Description of Artificial Sequence: Synthetic oligonucleotide
gaagagggttga

SEQ ID NO: 2110 - DNA, 12 bp, Artificial Sequence
  Description of Artificial Sequence: Synthetic oligonucleotide
agtgtaccatga

SEQ ID NO: 2111 - DNA, 12 bp, Artificial Sequence
  Description of Artificial Sequence: Synthetic oligonucleotide
tgttggatcgtg

SEQ ID NO: 2112 - DNA, 12 bp, Artificial Sequence
  Description of Artificial Sequence: Synthetic oligonucleotide
cgagtatacaac

SEQ ID NO: 2113 - DNA, 12 bp, Artificial Sequence
  Description of Artificial Sequence: Synthetic oligonucleotide
cacccgatggtt

SEQ ID NO: 2114 - DNA, 12 bp, Artificial Sequence
  Description of Artificial Sequence: Synthetic oligonucleotide
gcaagctgtctc

SEQ ID NO: 2115 - DNA, 12 bp, Artificial Sequence
  Description of Artificial Sequence: Synthetic oligonucleotide
agtagacttacg

SEQ ID NO: 2116 - DNA, 12 bp, Artificial Sequence
  Description of Artificial Sequence: Synthetic oligonucleotide
ccgattgaatcg

SEQ ID NO: 2117 - DNA, 12 bp, Artificial Sequence
  Description of Artificial Sequence: Synthetic oligonucleotide
actggatctcgc

SEQ ID NO: 2118 - DNA, 12 bp, Artificial Sequence
  Description of Artificial Sequence: Synthetic oligonucleotide
tacaccttacct

SEQ ID NO: 2119 - DNA, 12 bp, Artificial Sequence
  Description of Artificial Sequence: Synthetic oligonucleotide
ttctgagaggta

SEQ ID NO: 2120 - DNA, 12 bp, Artificial Sequence
  Description of Artificial Sequence: Synthetic oligonucleotide
agcggcctatta

SEQ ID NO: 2121 - DNA, 12 bp, Artificial Sequence
  Description of Artificial Sequence: Synthetic oligonucleotide
tggaaaccattg

SEQ ID NO: 2122 - DNA, 12 bp, Artificial Sequence
  Description of Artificial Sequence: Synthetic oligonucleotide
tatatgtgcgag

SEQ ID NO: 2123 - DNA, 12 bp, Artificial Sequence
  Description of Artificial Sequence: Synthetic oligonucleotide
tcaagggacctt

SEQ ID NO: 2124 - DNA, 12 bp, Artificial Sequence
  Description of Artificial Sequence: Synthetic oligonucleotide
cgttcaagctag

SEQ ID NO: 2125 - DNA, 12 bp, Artificial Sequence
  Description of Artificial Sequence: Synthetic oligonucleotide
atccctacggaa

SEQ ID NO: 2126 - DNA, 12 bp, Artificial Sequence
  Description of Artificial Sequence: Synthetic oligonucleotide
tcttcaactacc

SEQ ID NO: 2127 - DNA, 12 bp, Artificial Sequence
  Description of Artificial Sequence: Synthetic oligonucleotide
agtccgagttgt

SEQ ID NO: 2128 - DNA, 12 bp, Artificial Sequence
  Description of Artificial Sequence: Synthetic oligonucleotide
cacccacgttga

SEQ ID NO: 2129 - DNA, 12 bp, Artificial Sequence
  Description of Artificial Sequence: Synthetic oligonucleotide
aagtcgacacat

SEQ ID NO: 2130 - DNA, 12 bp, Artificial Sequence
  Description of Artificial Sequence: Synthetic oligonucleotide
aactcgcgctac

SEQ ID NO: 2131 - DNA, 12 bp, Artificial Sequence
  Description of Artificial Sequence: Synthetic oligonucleotide
ggttccattagg

SEQ ID NO: 2132 - DNA, 12 bp, Artificial Sequence
  Description of Artificial Sequence: Synthetic oligonucleotide
tggaattcggct

SEQ ID NO: 2133 - DNA, 12 bp, Artificial Sequence
  Description of Artificial Sequence: Synthetic oligonucleotide
ccgcgatttcga

SEQ ID NO: 2134 - DNA, 12 bp, Artificial Sequence
  Description of Artificial Sequence: Synthetic oligonucleotide
tagtgggtcaat

SEQ ID NO: 2135 - DNA, 12 bp, Artificial Sequence
  Description of Artificial Sequence: Synthetic oligonucleotide
aacattgcaggt

SEQ ID NO: 2136 - DNA, 12 bp, Artificial Sequence
  Description of Artificial Sequence: Synthetic oligonucleotide
taccaggattgc

SEQ ID NO: 2137 - DNA, 12 bp, Artificial Sequence
  Description of Artificial Sequence: Synthetic oligonucleotide
gtgttcccagaa

SEQ ID NO: 2138 - DNA, 12 bp, Artificial Sequence
  Description of Artificial Sequence: Synthetic oligonucleotide
taagatgcagtc

SEQ ID NO: 2139 - DNA, 12 bp, Artificial Sequence
  Description of Artificial Sequence: Synthetic oligonucleotide
acacaccctgac

SEQ ID NO: 2140 - DNA, 12 bp, Artificial Sequence
  Description of Artificial Sequence: Synthetic oligonucleotide
cctaaactacgg

SEQ ID NO: 2141 - DNA, 12 bp, Artificial Sequence
  Description of Artificial Sequence: Synthetic oligonucleotide
ccatgaagtgta

SEQ ID NO: 2142 - DNA, 12 bp, Artificial Sequence
  Description of Artificial Sequence: Synthetic oligonucleotide
ggttgtaagtgt

SEQ ID NO: 2143 - DNA, 12 bp, Artificial Sequence
  Description of Artificial Sequence: Synthetic oligonucleotide
ccgaggtataat

SEQ ID NO: 2144 - DNA, 12 bp, Artificial Sequence
  Description of Artificial Sequence: Synthetic oligonucleotide
tgccgagtaatc

SEQ ID NO: 2145 - DNA, 12 bp, Artificial Sequence
  Description of Artificial Sequence: Synthetic oligonucleotide
tcacgagtcaca

SEQ ID NO: 2146 - DNA, 12 bp, Artificial Sequence
  Description of Artificial Sequence: Synthetic oligonucleotide
actcccgtgtga

SEQ ID NO: 2147 - DNA, 12 bp, Artificial Sequence
  Description of Artificial Sequence: Synthetic oligonucleotide
tccacagggttc

SEQ ID NO: 2148 - DNA, 12 bp, Artificial Sequence
  Description of Artificial Sequence: Synthetic oligonucleotide
caacgaaccatc

SEQ ID NO: 2149 - DNA, 12 bp, Artificial Sequence
  Description of Artificial Sequence: Synthetic oligonucleotide
agcgtaattagc

SEQ ID NO: 2150 - DNA, 12 bp, Artificial Sequence
  Description of Artificial Sequence: Synthetic oligonucleotide
accttgacaaga

SEQ ID NO: 2151 - DNA, 12 bp, Artificial Sequence
  Description of Artificial Sequence: Synthetic oligonucleotide
cacaaagcgatt

SEQ ID NO: 2152 - DNA, 12 bp, Artificial Sequence
  Description of Artificial Sequence: Synthetic oligonucleotide
ctgcaagcctgt

SEQ ID NO: 2153 - DNA, 12 bp, Artificial Sequence
  Description of Artificial Sequence: Synthetic oligonucleotide
tcattagcgtgg

SEQ ID NO: 2154 - DNA, 12 bp, Artificial Sequence
  Description of Artificial Sequence: Synthetic oligonucleotide
ccatgcttagag

SEQ ID NO: 2155 - DNA, 12 bp, Artificial Sequence
  Description of Artificial Sequence: Synthetic oligonucleotide
ctcgtgaatgac

SEQ ID NO: 2156 - DNA, 12 bp, Artificial Sequence
  Description of Artificial Sequence: Synthetic oligonucleotide
gtaaccaccacc

SEQ ID NO: 2157 - DNA, 12 bp, Artificial Sequence
  Description of Artificial Sequence: Synthetic oligonucleotide
caccgtgacact

SEQ ID NO: 2158 - DNA, 12 bp, Artificial Sequence
  Description of Artificial Sequence: Synthetic oligonucleotide
ccaacagccaat

SEQ ID NO: 2159 - DNA, 12 bp, Artificial Sequence
  Description of Artificial Sequence: Synthetic oligonucleotide
atgtcgaatagc

SEQ ID NO: 2160 - DNA, 12 bp, Artificial Sequence
  Description of Artificial Sequence: Synthetic oligonucleotide
aatggcgactat

SEQ ID NO: 2161 - DNA, 12 bp, Artificial Sequence
  Description of Artificial Sequence: Synthetic oligonucleotide
aggtgagttcta

SEQ ID NO: 2162 - DNA, 12 bp, Artificial Sequence
  Description of Artificial Sequence: Synthetic oligonucleotide
catagctcggtc

SEQ ID NO: 2163 - DNA, 12 bp, Artificial Sequence
  Description of Artificial Sequence: Synthetic oligonucleotide
gaagatctatcg

SEQ ID NO: 2164 - DNA, 12 bp, Artificial Sequence
  Description of Artificial Sequence: Synthetic oligonucleotide
cggttcacatag

SEQ ID NO: 2165 - DNA, 12 bp, Artificial Sequence
  Description of Artificial Sequence: Synthetic oligonucleotide
ctgaccgttaag

SEQ ID NO: 2166 - DNA, 12 bp, Artificial Sequence
  Description of Artificial Sequence: Synthetic oligonucleotide
gacaggttgtat

SEQ ID NO: 2167 - DNA, 12 bp, Artificial Sequence
  Description of Artificial Sequence: Synthetic oligonucleotide
cctgtcctatct

SEQ ID NO: 2168 - DNA, 12 bp, Artificial Sequence
  Description of Artificial Sequence: Synthetic oligonucleotide
aaccatgccaac

SEQ ID NO: 2169 - DNA, 12 bp, Artificial Sequence
  Description of Artificial Sequence: Synthetic oligonucleotide
gacggaacagac

SEQ ID NO: 2170 - DNA, 12 bp, Artificial Sequence
  Description of Artificial Sequence: Synthetic oligonucleotide
tcaacagtagtg

SEQ ID NO: 2171 - DNA, 12 bp, Artificial Sequence
  Description of Artificial Sequence: Synthetic oligonucleotide
tcgggctcttag

SEQ ID NO: 2172 - DNA, 12 bp, Artificial Sequence
  Description of Artificial Sequence: Synthetic oligonucleotide
gactataatggc

SEQ ID NO: 2173 - DNA, 12 bp, Artificial Sequence
  Description of Artificial Sequence: Synthetic oligonucleotide
ggtttaacacgc

SEQ ID NO: 2174 - DNA, 12 bp, Artificial Sequence
  Description of Artificial Sequence: Synthetic oligonucleotide
tatggagctagt

SEQ ID NO: 2175 - DNA, 12 bp, Artificial Sequence
  Description of Artificial Sequence: Synthetic oligonucleotide
ggaccgctttca

SEQ ID NO: 2176 - DNA, 12 bp, Artificial Sequence
  Description of Artificial Sequence: Synthetic oligonucleotide
aacacatgggtt

SEQ ID NO: 2177 - DNA, 12 bp, Artificial Sequence
  Description of Artificial Sequence: Synthetic oligonucleotide
actttaagggtg

SEQ ID NO: 2178 - DNA, 12 bp, Artificial Sequence
  Description of Artificial Sequence: Synthetic oligonucleotide
ttcaggaactag

SEQ ID NO: 2179 - DNA, 12 bp, Artificial Sequence
  Description of Artificial Sequence: Synthetic oligonucleotide
agacagtaggag

SEQ ID NO: 2180 - DNA, 12 bp, Artificial Sequence
  Description of Artificial Sequence: Synthetic oligonucleotide
actacctcttca

SEQ ID NO: 2181 - DNA, 12 bp, Artificial Sequence
  Description of Artificial Sequence: Synthetic oligonucleotide
cacggtcctatg

SEQ ID NO: 2182 - DNA, 12 bp, Artificial Sequence
  Description of Artificial Sequence: Synthetic oligonucleotide
atcgtagtggtc

SEQ ID NO: 2183 - DNA, 12 bp, Artificial Sequence
  Description of Artificial Sequence: Synthetic oligonucleotide
tggaccactagt

SEQ ID NO: 2184 - DNA, 12 bp, Artificial Sequence
  Description of Artificial Sequence: Synthetic oligonucleotide
caacaggtaact

SEQ ID NO: 2185 - DNA, 12 bp, Artificial Sequence
  Description of Artificial Sequence: Synthetic oligonucleotide
gccacgacttac

SEQ ID NO: 2186 - DNA, 12 bp, Artificial Sequence
  Description of Artificial Sequence: Synthetic oligonucleotide
gatgataaccca

SEQ ID NO: 2187 - DNA, 12 bp, Artificial Sequence
  Description of Artificial Sequence: Synthetic oligonucleotide
gaatgacgtttg

SEQ ID NO: 2188 - DNA, 12 bp, Artificial Sequence
  Description of Artificial Sequence: Synthetic oligonucleotide
cgagtcacgatt

SEQ ID NO: 2189 - DNA, 12 bp, Artificial Sequence
  Description of Artificial Sequence: Synthetic oligonucleotide
aaccagcagatt

SEQ ID NO: 2190 - DNA, 12 bp, Artificial Sequence
  Description of Artificial Sequence: Synthetic oligonucleotide
tagttgagctga

SEQ ID NO: 2191 - DNA, 12 bp, Artificial Sequence
  Description of Artificial Sequence: Synthetic oligonucleotide
attgttcctacc

SEQ ID NO: 2192 - DNA, 12 bp, Artificial Sequence
  Description of Artificial Sequence: Synthetic oligonucleotide
ggcccaatataa

SEQ ID NO: 2193 - DNA, 12 bp, Artificial Sequence
  Description of Artificial Sequence: Synthetic oligonucleotide
acttacgccacg

SEQ ID NO: 2194 - DNA, 12 bp, Artificial Sequence
  Description of Artificial Sequence: Synthetic oligonucleotide
agtgcgttctag

SEQ ID NO: 2195 - DNA, 12 bp, Artificial Sequence
  Description of Artificial Sequence: Synthetic oligonucleotide
atcgaggatcta

SEQ ID NO: 2196 - DNA, 12 bp, Artificial Sequence
  Description of Artificial Sequence: Synthetic oligonucleotide
gtctcaaagcac

SEQ ID NO: 2197 - DNA, 12 bp, Artificial Sequence
  Description of Artificial Sequence: Synthetic oligonucleotide
gccgtaaacttg

SEQ ID NO: 2198 - DNA, 12 bp, Artificial Sequence
  Description of Artificial Sequence: Synthetic oligonucleotide
ttgtatgacagg

SEQ ID NO: 2199 - DNA, 12 bp, Artificial Sequence
  Description of Artificial Sequence: Synthetic oligonucleotide
acgcctttctta

SEQ ID NO: 2200 - DNA, 12 bp, Artificial Sequence
  Description of Artificial Sequence: Synthetic oligonucleotide
ttcttaacgcct

SEQ ID NO: 2201 - DNA, 12 bp, Artificial Sequence
  Description of Artificial Sequence: Synthetic oligonucleotide
tagctggcgttc

SEQ ID NO: 2202 - DNA, 12 bp, Artificial Sequence
  Description of Artificial Sequence: Synthetic oligonucleotide
agttgcctgaac

SEQ ID NO: 2203 - DNA, 12 bp, Artificial Sequence
  Description of Artificial Sequence: Synthetic oligonucleotide
gcagatttccag

SEQ ID NO: 2204 - DNA, 12 bp, Artificial Sequence
  Description of Artificial Sequence: Synthetic oligonucleotide
ggtaagtttgac

SEQ ID NO: 2205 - DNA, 12 bp, Artificial Sequence
  Description of Artificial Sequence: Synthetic oligonucleotide
ttggtgcctgtg

SEQ ID NO: 2206 - DNA, 12 bp, Artificial Sequence
  Description of Artificial Sequence: Synthetic oligonucleotide
acccagtatggt

SEQ ID NO: 2207 - DNA, 12 bp, Artificial Sequence
  Description of Artificial Sequence: Synthetic oligonucleotide
cacaagtatcga

SEQ ID NO: 2208 - DNA, 12 bp, Artificial Sequence
  Description of Artificial Sequence: Synthetic oligonucleotide
tggtagtctgaa

SEQ ID NO: 2209 - DNA, 12 bp, Artificial Sequence
  Description of Artificial Sequence: Synthetic oligonucleotide
agatgatcagtc

SEQ ID NO: 2210 - DNA, 12 bp, Artificial Sequence
  Description of Artificial Sequence: Synthetic oligonucleotide
ctaccacggtac

SEQ ID NO: 2211 - DNA, 12 bp, Artificial Sequence
  Description of Artificial Sequence: Synthetic oligonucleotide
catcggatctga

SEQ ID NO: 2212 - DNA, 12 bp, Artificial Sequence
  Description of Artificial Sequence: Synthetic oligonucleotide
cgttaagtcagc

SEQ ID NO: 2213 - DNA, 12 bp, Artificial Sequence
  Description of Artificial Sequence: Synthetic oligonucleotide
gattgtgcaacc

SEQ ID NO: 2214 - DNA, 12 bp, Artificial Sequence
  Description of Artificial Sequence: Synthetic oligonucleotide
gcatgtcgaaat

SEQ ID NO: 2215 - DNA, 12 bp, Artificial Sequence
  Description of Artificial Sequence: Synthetic oligonucleotide
gagacgtgttct

SEQ ID NO: 2216 - DNA, 12 bp, Artificial Sequence
  Description of Artificial Sequence: Synthetic oligonucleotide
cggtctgtctga

SEQ ID NO: 2217 - DNA, 12 bp, Artificial Sequence
  Description of Artificial Sequence: Synthetic oligonucleotide
catgtcttccat

SEQ ID NO: 2218 - DNA, 12 bp, Artificial Sequence
  Description of Artificial Sequence: Synthetic oligonucleotide
tcacaacaccgc

SEQ ID NO: 2219 - DNA, 12 bp, Artificial Sequence
  Description of Artificial Sequence: Synthetic oligonucleotide
ctacagggtctc

SEQ ID NO: 2220 - DNA, 12 bp, Artificial Sequence
  Description of Artificial Sequence: Synthetic oligonucleotide
cctatgcacggt

SEQ ID NO: 2221 - DNA, 12 bp, Artificial Sequence
  Description of Artificial Sequence: Synthetic oligonucleotide
tatcaccggcac

SEQ ID NO: 2222 - DNA, 12 bp, Artificial Sequence
  Description of Artificial Sequence: Synthetic oligonucleotide
gtacatgtcgcc

SEQ ID NO: 2223 - DNA, 12 bp, Artificial Sequence
  Description of Artificial Sequence: Synthetic oligonucleotide
gttacagttggc

SEQ ID NO: 2224 - DNA, 12 bp, Artificial Sequence
  Description of Artificial Sequence: Synthetic oligonucleotide
agcaaggtcttc

SEQ ID NO: 2225 - DNA, 12 bp, Artificial Sequence
  Description of Artificial Sequence: Synthetic oligonucleotide
gtaccaggtact

SEQ ID NO: 2226 - DNA, 12 bp, Artificial Sequence
  Description of Artificial Sequence: Synthetic oligonucleotide
gcgtggtcatta

SEQ ID NO: 2227 - DNA, 12 bp, Artificial Sequence
  Description of Artificial Sequence: Synthetic oligonucleotide
tatgccagagat

SEQ ID NO: 2228 - DNA, 12 bp, Artificial Sequence
  Description of Artificial Sequence: Synthetic oligonucleotide
ttctagagtgcg

SEQ ID NO: 2229 - DNA, 12 bp, Artificial Sequence
  Description of Artificial Sequence: Synthetic oligonucleotide
cggactcgttac

SEQ ID NO: 2230 - DNA, 12 bp, Artificial Sequence
  Description of Artificial Sequence: Synthetic oligonucleotide
tctaaaccctct

SEQ ID NO: 2231 - DNA, 12 bp, Artificial Sequence
  Description of Artificial Sequence: Synthetic oligonucleotide
gtatacccttct

SEQ ID NO: 2232 - DNA, 12 bp, Artificial Sequence
  Description of Artificial Sequence: Synthetic oligonucleotide
agtcacatccgc

SEQ ID NO: 2233 - DNA, 12 bp, Artificial Sequence
  Description of Artificial Sequence: Synthetic oligonucleotide
aggtccaaatca

SEQ ID NO: 2234 - DNA, 12 bp, Artificial Sequence
  Description of Artificial Sequence: Synthetic oligonucleotide
acggatgttatg

SEQ ID NO: 2235 - DNA, 12 bp, Artificial Sequence
  Description of Artificial Sequence: Synthetic oligonucleotide
tctcgcactgga

SEQ ID NO: 2236 - DNA, 12 bp, Artificial Sequence
  Description of Artificial Sequence: Synthetic oligonucleotide
cctgatcacacg

SEQ ID NO: 2237 - DNA, 12 bp, Artificial Sequence
  Description of Artificial Sequence: Synthetic oligonucleotide
taggtctaggtc

SEQ ID NO: 2238 - DNA, 12 bp, Artificial Sequence
  Description of Artificial Sequence: Synthetic oligonucleotide
agcgtctgaact

SEQ ID NO: 2239 - DNA, 12 bp, Artificial Sequence
  Description of Artificial Sequence: Synthetic oligonucleotide
accgtgctcaca

SEQ ID NO: 2240 - DNA, 12 bp, Artificial Sequence
  Description of Artificial Sequence: Synthetic oligonucleotide
ttgaggctacaa

SEQ ID NO: 2241 - DNA, 12 bp, Artificial Sequence
  Description of Artificial Sequence: Synthetic oligonucleotide
ttctggtcttgt

SEQ ID NO: 2242 - DNA, 12 bp, Artificial Sequence
  Description of Artificial Sequence: Synthetic oligonucleotide
aagctgcctagt

SEQ ID NO: 2243 - DNA, 12 bp, Artificial Sequence
  Description of Artificial Sequence: Synthetic oligonucleotide
gacagtagcttc

SEQ ID NO: 2244 - DNA, 12 bp, Artificial Sequence
  Description of Artificial Sequence: Synthetic oligonucleotide
atcgcgactgct

SEQ ID NO: 2245 - DNA, 12 bp, Artificial Sequence
  Description of Artificial Sequence: Synthetic oligonucleotide
ctccctttgtgt

SEQ ID NO: 2246 - DNA, 12 bp, Artificial Sequence
  Description of Artificial Sequence: Synthetic oligonucleotide
gtaggaaccgga

SEQ ID NO: 2247 - DNA, 12 bp, Artificial Sequence
  Description of Artificial Sequence: Synthetic oligonucleotide
gtccacttggac

SEQ ID NO: 2248 - DNA, 12 bp, Artificial Sequence
  Description of Artificial Sequence: Synthetic oligonucleotide
atttgtgggtag

SEQ ID NO: 2249 - DNA, 12 bp, Artificial Sequence
  Description of Artificial Sequence: Synthetic oligonucleotide
tgaacgttggat

SEQ ID NO: 2250 - DNA, 12 bp, Artificial Sequence
  Description of Artificial Sequence: Synthetic oligonucleotide
tggaggttctca

SEQ ID NO: 2251 - DNA, 12 bp, Artificial Sequence
  Description of Artificial Sequence: Synthetic oligonucleotide
agctgcacctaa

SEQ ID NO: 2252 - DNA, 12 bp, Artificial Sequence
  Description of Artificial Sequence: Synthetic oligonucleotide
acatctagcaga

SEQ ID NO: 2253 - DNA, 12 bp, Artificial Sequence
  Description of Artificial Sequence: Synthetic oligonucleotide
gatttagaggct

SEQ ID NO: 2254 - DNA, 12 bp, Artificial Sequence
  Description of Artificial Sequence: Synthetic oligonucleotide
tacatggagcat

SEQ ID NO: 2255 - DNA, 12 bp, Artificial Sequence
  Description of Artificial Sequence: Synthetic oligonucleotide
agtgtgaacgtt

SEQ ID NO: 2256 - DNA, 12 bp, Artificial Sequence
  Description of Artificial Sequence: Synthetic oligonucleotide
tgcttgtaggca

SEQ ID NO: 2257 - DNA, 12 bp, Artificial Sequence
  Description of Artificial Sequence: Synthetic oligonucleotide
ccttgaccgatg

SEQ ID NO: 2258 - DNA, 12 bp, Artificial Sequence
  Description of Artificial Sequence: Synthetic oligonucleotide
ccgacattgtag

SEQ ID NO: 2259 - DNA, 12 bp, Artificial Sequence
  Description of Artificial Sequence: Synthetic oligonucleotide
gtcagccgttaa

SEQ ID NO: 2260 - DNA, 12 bp, Artificial Sequence
  Description of Artificial Sequence: Synthetic oligonucleotide
gcctcagcagtt

SEQ ID NO: 2261 - DNA, 12 bp, Artificial Sequence
  Description of Artificial Sequence: Synthetic oligonucleotide
atggtcacaaac

SEQ ID NO: 2262 - DNA, 12 bp, Artificial Sequence
  Description of Artificial Sequence: Synthetic oligonucleotide
cttaaatgggca

SEQ ID NO: 2263 - DNA, 12 bp, Artificial Sequence
  Description of Artificial Sequence: Synthetic oligonucleotide
ctatcatcctca

SEQ ID NO: 2264 - DNA, 12 bp, Artificial Sequence
  Description of Artificial Sequence: Synthetic oligonucleotide
catgtaaggctc

SEQ ID NO: 2265 - DNA, 12 bp, Artificial Sequence
  Description of Artificial Sequence: Synthetic oligonucleotide
acggtttctgga

SEQ ID NO: 2266 - DNA, 12 bp, Artificial Sequence
  Description of Artificial Sequence: Synthetic oligonucleotide
catcttctgatc

SEQ ID NO: 2267 - DNA, 12 bp, Artificial Sequence
  Description of Artificial Sequence: Synthetic oligonucleotide
acatagcggttc

SEQ ID NO: 2268 - DNA, 12 bp, Artificial Sequence
  Description of Artificial Sequence: Synthetic oligonucleotide
ggtatcaccctg

SEQ ID NO: 2269 - DNA, 12 bp, Artificial Sequence
  Description of Artificial Sequence: Synthetic oligonucleotide
actctagccggt

SEQ ID NO: 2270 - DNA, 12 bp, Artificial Sequence
  Description of Artificial Sequence: Synthetic oligonucleotide
tgcaagctaagt

SEQ ID NO: 2271 - DNA, 12 bp, Artificial Sequence
  Description of Artificial Sequence: Synthetic oligonucleotide
gcagccatattg

SEQ ID NO: 2272 - DNA, 12 bp, Artificial Sequence
  Description of Artificial Sequence: Synthetic oligonucleotide
caggttgtgcct

SEQ ID NO: 2273 - DNA, 12 bp, Artificial Sequence
  Description of Artificial Sequence: Synthetic oligonucleotide
gctgtttgaccg

SEQ ID NO: 2274 - DNA, 12 bp, Artificial Sequence
  Description of Artificial Sequence: Synthetic oligonucleotide
cgccttgataag

SEQ ID NO: 2275 - DNA, 12 bp, Artificial Sequence
  Description of Artificial Sequence: Synthetic oligonucleotide
cgataggcctta

SEQ ID NO: 2276 - DNA, 12 bp, Artificial Sequence
  Description of Artificial Sequence: Synthetic oligonucleotide
gtgtgtgccata

SEQ ID NO: 2277 - DNA, 12 bp, Artificial Sequence
  Description of Artificial Sequence: Synthetic oligonucleotide
ataggtgtgcta

SEQ ID NO: 2278 - DNA, 12 bp, Artificial Sequence
  Description of Artificial Sequence: Synthetic oligonucleotide
ggttgccctgta

SEQ ID NO: 2279 - DNA, 12 bp, Artificial Sequence
  Description of Artificial Sequence: Synthetic oligonucleotide
cgaatactgaca

SEQ ID NO: 2280 - DNA, 12 bp, Artificial Sequence
  Description of Artificial Sequence: Synthetic oligonucleotide
cgtttatccgtt

SEQ ID NO: 2281 - DNA, 12 bp, Artificial Sequence
  Description of Artificial Sequence: Synthetic oligonucleotide
aatgacctcgtg

SEQ ID NO: 2282 - DNA, 12 bp, Artificial Sequence
  Description of Artificial Sequence: Synthetic oligonucleotide
tgacaaccgaat

SEQ ID NO: 2283 - DNA, 12 bp, Artificial Sequence
  Description of Artificial Sequence: Synthetic oligonucleotide
acctagctagtg

SEQ ID NO: 2284 - DNA, 12 bp, Artificial Sequence
  Description of Artificial Sequence: Synthetic oligonucleotide
tggtttcgaaga

SEQ ID NO: 2285 - DNA, 12 bp, Artificial Sequence
  Description of Artificial Sequence: Synthetic oligonucleotide
tatcctggtttc

SEQ ID NO: 2286 - DNA, 12 bp, Artificial Sequence
  Description of Artificial Sequence: Synthetic oligonucleotide
ttgtactcactc

SEQ ID NO: 2287 - DNA, 12 bp, Artificial Sequence
  Description of Artificial Sequence: Synthetic oligonucleotide
cttaggcatgtg

SEQ ID NO: 2288 - DNA, 12 bp, Artificial Sequence
  Description of Artificial Sequence: Synthetic oligonucleotide
taggctcgtgct

SEQ ID NO: 2289 - DNA, 12 bp, Artificial Sequence
  Description of Artificial Sequence: Synthetic oligonucleotide
gtcctgacactg

SEQ ID NO: 2290 - DNA, 12 bp, Artificial Sequence
  Description of Artificial Sequence: Synthetic oligonucleotide
tgcgttctagcg

SEQ ID NO: 2291 - DNA, 12 bp, Artificial Sequence
  Description of Artificial Sequence: Synthetic oligonucleotide
cattgtccctat

SEQ ID NO: 2292 - DNA, 12 bp, Artificial Sequence
  Description of Artificial Sequence: Synthetic oligonucleotide
ttcccacccatt

SEQ ID NO: 2293 - DNA, 12 bp, Artificial Sequence
  Description of Artificial Sequence: Synthetic oligonucleotide
ccagatatagca

SEQ ID NO: 2294 - DNA, 12 bp, Artificial Sequence
  Description of Artificial Sequence: Synthetic oligonucleotide
ctccttaaggcg

SEQ ID NO: 2295 - DNA, 12 bp, Artificial Sequence
  Description of Artificial Sequence: Synthetic oligonucleotide
ggactcaactaa

SEQ ID NO: 2296 - DNA, 12 bp, Artificial Sequence
  Description of Artificial Sequence: Synthetic oligonucleotide
agtccactggta

SEQ ID NO: 2297 - DNA, 12 bp, Artificial Sequence
  Description of Artificial Sequence: Synthetic oligonucleotide
accgacgcttgt

SEQ ID NO: 2298 - DNA, 12 bp, Artificial Sequence
  Description of Artificial Sequence: Synthetic oligonucleotide
gccgcattcgat

SEQ ID NO: 2299 - DNA, 12 bp, Artificial Sequence
  Description of Artificial Sequence: Synthetic oligonucleotide
gagagtccactt

SEQ ID NO: 2300 - DNA, 12 bp, Artificial Sequence
  Description of Artificial Sequence: Synthetic oligonucleotide
ttgcctgggtca

SEQ ID NO: 2301 - DNA, 12 bp, Artificial Sequence
  Description of Artificial Sequence: Synthetic oligonucleotide
atacgggttcgt

SEQ ID NO: 2302 - DNA, 12 bp, Artificial Sequence
  Description of Artificial Sequence: Synthetic oligonucleotide
gaactcgctatg

SEQ ID NO: 2303 - DNA, 12 bp, Artificial Sequence
  Description of Artificial Sequence: Synthetic oligonucleotide
ctgtgatcggat

SEQ ID NO: 2304 - DNA, 12 bp, Artificial Sequence
  Description of Artificial Sequence: Synthetic oligonucleotide
gaacgggacgta

SEQ ID NO: 2305 - DNA, 12 bp, Artificial Sequence
  Description of Artificial Sequence: Synthetic oligonucleotide
caattctgcttc

SEQ ID NO: 2306 - DNA, 12 bp, Artificial Sequence
  Description of Artificial Sequence: Synthetic oligonucleotide
cctttcacctgt

SEQ ID NO: 2307 - DNA, 12 bp, Artificial Sequence
  Description of Artificial Sequence: Synthetic oligonucleotide
ggtagttcatag

SEQ ID NO: 2308 - DNA, 12 bp, Artificial Sequence
  Description of Artificial Sequence: Synthetic oligonucleotide
atgtacaccggt

SEQ ID NO: 2309 - DNA, 12 bp, Artificial Sequence
  Description of Artificial Sequence: Synthetic oligonucleotide
acgtgtaggctt

SEQ ID NO: 2310 - DNA, 12 bp, Artificial Sequence
  Description of Artificial Sequence: Synthetic oligonucleotide
actggcaaacct

SEQ ID NO: 2311 - DNA, 12 bp, Artificial Sequence
  Description of Artificial Sequence: Synthetic oligonucleotide
atcagccagctc

SEQ ID NO: 2312 - DNA, 12 bp, Artificial Sequence
  Description of Artificial Sequence: Synthetic oligonucleotide
aggatgggatgc

SEQ ID NO: 2313 - DNA, 12 bp, Artificial Sequence
  Description of Artificial Sequence: Synthetic oligonucleotide
taagctaaaccg

SEQ ID NO: 2314 - DNA, 12 bp, Artificial Sequence
  Description of Artificial Sequence: Synthetic oligonucleotide
ggtctcctacag

SEQ ID NO: 2315 - DNA, 12 bp, Artificial Sequence
  Description of Artificial Sequence: Synthetic oligonucleotide
aatcagagcttg

SEQ ID NO: 2316 - DNA, 12 bp, Artificial Sequence
  Description of Artificial Sequence: Synthetic oligonucleotide
gctccacaacgt

SEQ ID NO: 2317 - DNA, 12 bp, Artificial Sequence
  Description of Artificial Sequence: Synthetic oligonucleotide
cagtgatactgc

SEQ ID NO: 2318 - DNA, 12 bp, Artificial Sequence
  Description of Artificial Sequence: Synthetic oligonucleotide
cattgggagttc

SEQ ID NO: 2319 - DNA, 12 bp, Artificial Sequence
  Description of Artificial Sequence: Synthetic oligonucleotide
actgacttaagg

SEQ ID NO: 2320 - DNA, 12 bp, Artificial Sequence
  Description of Artificial Sequence: Synthetic oligonucleotide
caatgtagacac

SEQ ID NO: 2321 - DNA, 12 bp, Artificial Sequence
  Description of Artificial Sequence: Synthetic oligonucleotide
aaggagtgcgca

SEQ ID NO: 2322 - DNA, 12 bp, Artificial Sequence
  Description of Artificial Sequence: Synthetic oligonucleotide
gaggatactact

SEQ ID NO: 2323 - DNA, 12 bp, Artificial Sequence
  Description of Artificial Sequence: Synthetic oligonucleotide
gatcggttaatg

SEQ ID NO: 2324 - DNA, 12 bp, Artificial Sequence
  Description of Artificial Sequence: Synthetic oligonucleotide
gatgctgccgtt

SEQ ID NO: 2325 - DNA, 12 bp, Artificial Sequence
  Description of Artificial Sequence: Synthetic oligonucleotide
tggcgatacgtt

SEQ ID NO: 2326 - DNA, 12 bp, Artificial Sequence
  Description of Artificial Sequence: Synthetic oligonucleotide
agggaaaggatc

SEQ ID NO: 2327 - DNA, 12 bp, Artificial Sequence
  Description of Artificial Sequence: Synthetic oligonucleotide
gcatcgtctggt

SEQ ID NO: 2328 - DNA, 12 bp, Artificial Sequence
  Description of Artificial Sequence: Synthetic oligonucleotide
cagcgactgtta

SEQ ID NO: 2329 - DNA, 12 bp, Artificial Sequence
  Description of Artificial Sequence: Synthetic oligonucleotide
ttcctaggccag

SEQ ID NO: 2330 - DNA, 12 bp, Artificial Sequence
  Description of Artificial Sequence: Synthetic oligonucleotide
gccttacgatag

SEQ ID NO: 2331 - DNA, 12 bp, Artificial Sequence
  Description of Artificial Sequence: Synthetic oligonucleotide
acgacgcatttg

SEQ ID NO: 2332 - DNA, 12 bp, Artificial Sequence
  Description of Artificial Sequence: Synthetic oligonucleotide
tatgggtagcta

SEQ ID NO: 2333 - DNA, 12 bp, Artificial Sequence
  Description of Artificial Sequence: Synthetic oligonucleotide
gagcccaaagag

SEQ ID NO: 2334 - DNA, 12 bp, Artificial Sequence
  Description of Artificial Sequence: Synthetic oligonucleotide
attaagcctgga

SEQ ID NO: 2335 - DNA, 12 bp, Artificial Sequence
  Description of Artificial Sequence: Synthetic oligonucleotide
tacctgtgtctt

SEQ ID NO: 2336 - DNA, 12 bp, Artificial Sequence
  Description of Artificial Sequence: Synthetic oligonucleotide
cgtcactccaag

SEQ ID NO: 2337 - DNA, 12 bp, Artificial Sequence
  Description of Artificial Sequence: Synthetic oligonucleotide
aggtattaccga

SEQ ID NO: 2338 - DNA, 12 bp, Artificial Sequence
  Description of Artificial Sequence: Synthetic oligonucleotide
cgatcaccacaa

SEQ ID NO: 2339 - DNA, 12 bp, Artificial Sequence
  Description of Artificial Sequence: Synthetic oligonucleotide
tggctttctatc

SEQ ID NO: 2340 - DNA, 12 bp, Artificial Sequence
  Description of Artificial Sequence: Synthetic oligonucleotide
aacgaggcaacg

SEQ ID NO: 2341 - DNA, 12 bp, Artificial Sequence
  Description of Artificial Sequence: Synthetic oligonucleotide
ttacacaaaggc

SEQ ID NO: 2342 - DNA, 12 bp, Artificial Sequence
  Description of Artificial Sequence: Synthetic oligonucleotide
tgtcaaagtgac

SEQ ID NO: 2343 - DNA, 12 bp, Artificial Sequence
  Description of Artificial Sequence: Synthetic oligonucleotide
ctagagctccca

SEQ ID NO: 2344 - DNA, 12 bp, Artificial Sequence
  Description of Artificial Sequence: Synthetic oligonucleotide
acagctcaaaca

SEQ ID NO: 2345 - DNA, 12 bp, Artificial Sequence
  Description of Artificial Sequence: Synthetic oligonucleotide
gaagacagcgac

SEQ ID NO: 2346 - DNA, 12 bp, Artificial Sequence
  Description of Artificial Sequence: Synthetic oligonucleotide
gtatagtccgtg

SEQ ID NO: 2347 - DNA, 12 bp, Artificial Sequence
  Description of Artificial Sequence: Synthetic oligonucleotide
gtaacggctcta

SEQ ID NO: 2348 - DNA, 12 bp, Artificial Sequence
  Description of Artificial Sequence: Synthetic oligonucleotide
gaacgcaattcc

SEQ ID NO: 2349 - DNA, 12 bp, Artificial Sequence
  Description of Artificial Sequence: Synthetic oligonucleotide
gagcgtatccat

SEQ ID NO: 2350 - DNA, 12 bp, Artificial Sequence
  Description of Artificial Sequence: Synthetic oligonucleotide
acacctgcgatc

SEQ ID NO: 2351 - DNA, 12 bp, Artificial Sequence
  Description of Artificial Sequence: Synthetic oligonucleotide
tcgtaagccgtc

SEQ ID NO: 2352 - DNA, 12 bp, Artificial Sequence
  Description of Artificial Sequence: Synthetic oligonucleotide
gtgtacataacg

SEQ ID NO: 2353 - DNA, 12 bp, Artificial Sequence
  Description of Artificial Sequence: Synthetic oligonucleotide
atccgtctgacg

SEQ ID NO: 2354 - DNA, 12 bp, Artificial Sequence
  Description of Artificial Sequence: Synthetic oligonucleotide
atgggcgaatgg

SEQ ID NO: 2355 - DNA, 12 bp, Artificial Sequence
  Description of Artificial Sequence: Synthetic oligonucleotide
ggcgttgcattc

SEQ ID NO: 2356 - DNA, 12 bp, Artificial Sequence
  Description of Artificial Sequence: Synthetic oligonucleotide
tgacgcctccaa

SEQ ID NO: 2357 - DNA, 12 bp, Artificial Sequence
  Description of Artificial Sequence: Synthetic oligonucleotide
tgctgctcaacg

SEQ ID NO: 2358 - DNA, 12 bp, Artificial Sequence
  Description of Artificial Sequence: Synthetic oligonucleotide
tgaaatgtcccg

SEQ ID NO: 2359 - DNA, 12 bp, Artificial Sequence
  Description of Artificial Sequence: Synthetic oligonucleotide
gatctctgggta

SEQ ID NO: 2360 - DNA, 12 bp, Artificial Sequence
  Description of Artificial Sequence: Synthetic oligonucleotide
actagcgttcag

SEQ ID NO: 2361 - DNA, 12 bp, Artificial Sequence
  Description of Artificial Sequence: Synthetic oligonucleotide
ttctcggttctc

SEQ ID NO: 2362 - DNA, 12 bp, Artificial Sequence
  Description of Artificial Sequence: Synthetic oligonucleotide
cggatgcaagag

SEQ ID NO: 2363 - DNA, 12 bp, Artificial Sequence
  Description of Artificial Sequence: Synthetic oligonucleotide
attcgccaagaa

SEQ ID NO: 2364 - DNA, 12 bp, Artificial Sequence
  Description of Artificial Sequence: Synthetic oligonucleotide
catcatacgggt

SEQ ID NO: 2365 - DNA, 12 bp, Artificial Sequence
  Description of Artificial Sequence: Synthetic oligonucleotide
ttgcgacaaagt

SEQ ID NO: 2366 - DNA, 12 bp, Artificial Sequence
  Description of Artificial Sequence: Synthetic oligonucleotide
gctactggtatg

SEQ ID NO: 2367 - DNA, 12 bp, Artificial Sequence
  Description of Artificial Sequence: Synthetic oligonucleotide
tgacattcacgg

SEQ ID NO: 2368 - DNA, 12 bp, Artificial Sequence
  Description of Artificial Sequence: Synthetic oligonucleotide
tacgtgatcccg

SEQ ID NO: 2369 - DNA, 12 bp, Artificial Sequence
  Description of Artificial Sequence: Synthetic oligonucleotide
tacggattatgg

SEQ ID NO: 2370 - DNA, 12 bp, Artificial Sequence
  Description of Artificial Sequence: Synthetic oligonucleotide
tgcgagtatatg

SEQ ID NO: 2371 - DNA, 12 bp, Artificial Sequence
  Description of Artificial Sequence: Synthetic oligonucleotide
gaatcctcaccg

SEQ ID NO: 2372 - DNA, 12 bp, Artificial Sequence
  Description of Artificial Sequence: Synthetic oligonucleotide
cacatattgggc

SEQ ID NO: 2373 - DNA, 12 bp, Artificial Sequence
  Description of Artificial Sequence: Synthetic oligonucleotide
tgggtagatctc

SEQ ID NO: 2374 - DNA, 12 bp, Artificial Sequence
  Description of Artificial Sequence: Synthetic oligonucleotide
atagcgaactca

SEQ ID NO: 2375 - DNA, 12 bp, Artificial Sequence
  Description of Artificial Sequence: Synthetic oligonucleotide
taccacaacgaa

SEQ ID NO: 2376 - DNA, 12 bp, Artificial Sequence
  Description of Artificial Sequence: Synthetic oligonucleotide
cctgacacacac

SEQ ID NO: 2377 - DNA, 12 bp, Artificial Sequence
  Description of Artificial Sequence: Synthetic oligonucleotide
ttcaatagggac

SEQ ID NO: 2378 - DNA, 12 bp, Artificial Sequence
  Description of Artificial Sequence: Synthetic oligonucleotide
agcaatcggtat

SEQ ID NO: 2379 - DNA, 12 bp, Artificial Sequence
  Description of Artificial Sequence: Synthetic oligonucleotide
taacgctgtgtg

SEQ ID NO: 2380 - DNA, 12 bp, Artificial Sequence
  Description of Artificial Sequence: Synthetic oligonucleotide
tctggaacggtt

SEQ ID NO: 2381 - DNA, 12 bp, Artificial Sequence
  Description of Artificial Sequence: Synthetic oligonucleotide
cagcgtttagcc

SEQ ID NO: 2382 - DNA, 12 bp, Artificial Sequence
  Description of Artificial Sequence: Synthetic oligonucleotide
atagccgatgtc

SEQ ID NO: 2383 - DNA, 12 bp, Artificial Sequence
  Description of Artificial Sequence: Synthetic oligonucleotide
gttggacgaagg

SEQ ID NO: 2384 - DNA, 12 bp, Artificial Sequence
  Description of Artificial Sequence: Synthetic oligonucleotide
aaccaaactcga

SEQ ID NO: 2385 - DNA, 12 bp, Artificial Sequence
  Description of Artificial Sequence: Synthetic oligonucleotide
gtactacctcgg

SEQ ID NO: 2386 - DNA, 12 bp, Artificial Sequence
  Description of Artificial Sequence: Synthetic oligonucleotide
ggtatggctact

SEQ ID NO: 2387 - DNA, 12 bp, Artificial Sequence
  Description of Artificial Sequence: Synthetic oligonucleotide
atgcgtaatgca

SEQ ID NO: 2388 - DNA, 12 bp, Artificial Sequence
  Description of Artificial Sequence: Synthetic oligonucleotide
acactatgaagc

SEQ ID NO: 2389 - DNA, 12 bp, Artificial Sequence
  Description of Artificial Sequence: Synthetic oligonucleotide
gccgtctcgtaa

SEQ ID NO: 2390 - DNA, 12 bp, Artificial Sequence
  Description of Artificial Sequence: Synthetic oligonucleotide
ttcctgttaacc

SEQ ID NO: 2391 - DNA, 12 bp, Artificial Sequence
  Description of Artificial Sequence: Synthetic oligonucleotide
acaatgtcacag

SEQ ID NO: 2392 - DNA, 12 bp, Artificial Sequence
  Description of Artificial Sequence: Synthetic oligonucleotide
actccgatagac

SEQ ID NO: 2393 - DNA, 12 bp, Artificial Sequence
  Description of Artificial Sequence: Synthetic oligonucleotide
acggaaatccct

SEQ ID NO: 2394 - DNA, 12 bp, Artificial Sequence
  Description of Artificial Sequence: Synthetic oligonucleotide
ctgggtatctcg

SEQ ID NO: 2395 - DNA, 12 bp, Artificial Sequence
  Description of Artificial Sequence: Synthetic oligonucleotide
ctatccaagtgg

SEQ ID NO: 2396 - DNA, 12 bp, Artificial Sequence
  Description of Artificial Sequence: Synthetic oligonucleotide
gccatagtgtgt

SEQ ID NO: 2397 - DNA, 12 bp, Artificial Sequence
  Description of Artificial Sequence: Synthetic oligonucleotide
gctgagcctttg

SEQ ID NO: 2398 - DNA, 12 bp, Artificial Sequence
  Description of Artificial Sequence: Synthetic oligonucleotide
ggtttctatcct

SEQ ID NO: 2399 - DNA, 12 bp, Artificial Sequence
  Description of Artificial Sequence: Synthetic oligonucleotide
gactacccgttg

SEQ ID NO: 2400 - DNA, 12 bp, Artificial Sequence
  Description of Artificial Sequence: Synthetic oligonucleotide
cagtctagtacg

SEQ ID NO: 2401 - DNA, 12 bp, Artificial Sequence
  Description of Artificial Sequence: Synthetic oligonucleotide
ggtcccgaaatt

SEQ ID NO: 2402 - DNA, 12 bp, Artificial Sequence
  Description of Artificial Sequence: Synthetic oligonucleotide
aacagagagagc

SEQ ID NO: 2403 - DNA, 12 bp, Artificial Sequence
  Description of Artificial Sequence: Synthetic oligonucleotide
acgcaatgtctg

SEQ ID NO: 2404 - DNA, 12 bp, Artificial Sequence
  Description of Artificial Sequence: Synthetic oligonucleotide
gcgttgcaaact

SEQ ID NO: 2405 - DNA, 12 bp, Artificial Sequence
  Description of Artificial Sequence: Synthetic oligonucleotide
gtgtccggattc

SEQ ID NO: 2406 - DNA, 12 bp, Artificial Sequence
  Description of Artificial Sequence: Synthetic oligonucleotide
tctgcgagtctg

SEQ ID NO: 2407 - DNA, 12 bp, Artificial Sequence
  Description of Artificial Sequence: Synthetic oligonucleotide
aattccgaacgc

SEQ ID NO: 2408 - DNA, 12 bp, Artificial Sequence
  Description of Artificial Sequence: Synthetic oligonucleotide
tcggttacgctg

SEQ ID NO: 2409 - DNA, 12 bp, Artificial Sequence
  Description of Artificial Sequence: Synthetic oligonucleotide
aaccgcataagt

SEQ ID NO: 2410 - DNA, 12 bp, Artificial Sequence
  Description of Artificial Sequence: Synthetic oligonucleotide
tgtggtgatgta

SEQ ID NO: 2411 - DNA, 12 bp, Artificial Sequence
  Description of Artificial Sequence: Synthetic oligonucleotide
atgtaggcttag

SEQ ID NO: 2412 - DNA, 12 bp, Artificial Sequence
  Description of Artificial Sequence: Synthetic oligonucleotide
ttagtacgcaga

SEQ ID NO: 2413 - DNA, 12 bp, Artificial Sequence
  Description of Artificial Sequence: Synthetic oligonucleotide
aagccattgaac

SEQ ID NO: 2414 - DNA, 12 bp, Artificial Sequence
  Description of Artificial Sequence: Synthetic oligonucleotide
accttacacctt

SEQ ID NO: 2415 - DNA, 12 bp, Artificial Sequence
  Description of Artificial Sequence: Synthetic oligonucleotide
ctttcgttcaac

SEQ ID NO: 2416 - DNA, 12 bp, Artificial Sequence
  Description of Artificial Sequence: Synthetic oligonucleotide
tgcttccaattc

SEQ ID NO: 2417 - DNA, 12 bp, Artificial Sequence
  Description of Artificial Sequence: Synthetic oligonucleotide
gaatctgacaac

SEQ ID NO: 2418 - DNA, 12 bp, Artificial Sequence
  Description of Artificial Sequence: Synthetic oligonucleotide
cgattgttccgg

SEQ ID NO: 2419 - DNA, 12 bp, Artificial Sequence
  Description of Artificial Sequence: Synthetic oligonucleotide
gtaggtgcttac

SEQ ID NO: 2420 - DNA, 12 bp, Artificial Sequence
  Description of Artificial Sequence: Synthetic oligonucleotide
ccgaagattctg

SEQ ID NO: 2421 - DNA, 12 bp, Artificial Sequence
  Description of Artificial Sequence: Synthetic oligonucleotide
gccgagataatt

SEQ ID NO: 2422 - DNA, 12 bp, Artificial Sequence
  Description of Artificial Sequence: Synthetic oligonucleotide
cacactgaagtc

SEQ ID NO: 2423 - DNA, 12 bp, Artificial Sequence
  Description of Artificial Sequence: Synthetic oligonucleotide
cctaagagcatc

SEQ ID NO: 2424 - DNA, 12 bp, Artificial Sequence
  Description of Artificial Sequence: Synthetic oligonucleotide
cgcatttggatg

SEQ ID NO: 2425 - DNA, 12 bp, Artificial Sequence
  Description of Artificial Sequence: Synthetic oligonucleotide
gttggcgttaca

SEQ ID NO: 2426 - DNA, 12 bp, Artificial Sequence
  Description of Artificial Sequence: Synthetic oligonucleotide
tcgagtatcgaa

SEQ ID NO: 2427 - DNA, 12 bp, Artificial Sequence
  Description of Artificial Sequence: Synthetic oligonucleotide
actatcagtggc

SEQ ID NO: 2428 - DNA, 12 bp, Artificial Sequence
  Description of Artificial Sequence: Synthetic oligonucleotide
gatggtttcagc

SEQ ID NO: 2429 - DNA, 12 bp, Artificial Sequence
  Description of Artificial Sequence: Synthetic oligonucleotide
ataacatgtgcg

SEQ ID NO: 2430 - DNA, 12 bp, Artificial Sequence
  Description of Artificial Sequence: Synthetic oligonucleotide
gaagtagcgagc

SEQ ID NO: 2431 - DNA, 12 bp, Artificial Sequence
  Description of Artificial Sequence: Synthetic oligonucleotide
gccctatcttct

SEQ ID NO: 2432 - DNA, 12 bp, Artificial Sequence
  Description of Artificial Sequence: Synthetic oligonucleotide
agactcagactc

SEQ ID NO: 2433 - DNA, 12 bp, Artificial Sequence
  Description of Artificial Sequence: Synthetic oligonucleotide
taattgcagagc

SEQ ID NO: 2434 - DNA, 12 bp, Artificial Sequence
  Description of Artificial Sequence: Synthetic oligonucleotide
cttgagaaatcg

SEQ ID NO: 2435 - DNA, 12 bp, Artificial Sequence
  Description of Artificial Sequence: Synthetic oligonucleotide
ttgcggacccta

SEQ ID NO: 2436 - DNA, 12 bp, Artificial Sequence
  Description of Artificial Sequence: Synthetic oligonucleotide
aggtacgcaatt

SEQ ID NO: 2437 - DNA, 12 bp, Artificial Sequence
  Description of Artificial Sequence: Synthetic oligonucleotide
gacctttcaagg

SEQ ID NO: 2438 - DNA, 12 bp, Artificial Sequence
  Description of Artificial Sequence: Synthetic oligonucleotide
taccggcttgca

SEQ ID NO: 2439 - DNA, 12 bp, Artificial Sequence
  Description of Artificial Sequence: Synthetic oligonucleotide
ctacacagcaca

SEQ ID NO: 2440 - DNA, 12 bp, Artificial Sequence
  Description of Artificial Sequence: Synthetic oligonucleotide
gcggaaacatgg

SEQ ID NO: 2441 - DNA, 12 bp, Artificial Sequence
  Description of Artificial Sequence: Synthetic oligonucleotide
gtccctattatc

SEQ ID NO: 2442 - DNA, 12 bp, Artificial Sequence
  Description of Artificial Sequence: Synthetic oligonucleotide
caagcaggtgag

SEQ ID NO: 2443 - DNA, 12 bp, Artificial Sequence
  Description of Artificial Sequence: Synthetic oligonucleotide
agtcggcatctc

SEQ ID NO: 2444 - DNA, 12 bp, Artificial Sequence
  Description of Artificial Sequence: Synthetic oligonucleotide
gaaatgctacgt

SEQ ID NO: 2445 - DNA, 12 bp, Artificial Sequence
  Description of Artificial Sequence: Synthetic oligonucleotide
aacgttagtgtg

SEQ ID NO: 2446 - DNA, 12 bp, Artificial Sequence
  Description of Artificial Sequence: Synthetic oligonucleotide
tgggacatatcc

SEQ ID NO: 2447 - DNA, 12 bp, Artificial Sequence
  Description of Artificial Sequence: Synthetic oligonucleotide
ggagaacgacac

SEQ ID NO: 2448 - DNA, 12 bp, Artificial Sequence
  Description of Artificial Sequence: Synthetic oligonucleotide
atatacctgcgg

SEQ ID NO: 2449 - DNA, 12 bp, Artificial Sequence
  Description of Artificial Sequence: Synthetic oligonucleotide
tctgaggttgcc

SEQ ID NO: 2450 - DNA, 12 bp, Artificial Sequence
  Description of Artificial Sequence: Synthetic oligonucleotide
tgcatgacagtc

SEQ ID NO: 2451 - DNA, 12 bp, Artificial Sequence
  Description of Artificial Sequence: Synthetic oligonucleotide
gaacgatcatgt

SEQ ID NO: 2452 - DNA, 12 bp, Artificial Sequence
  Description of Artificial Sequence: Synthetic oligonucleotide
cagcttcgactg

SEQ ID NO: 2453 - DNA, 12 bp, Artificial Sequence
  Description of Artificial Sequence: Synthetic oligonucleotide
tgtctgacgcaa

SEQ ID NO: 2454 - DNA, 12 bp, Artificial Sequence
  Description of Artificial Sequence: Synthetic oligonucleotide
gatcattctctc

SEQ ID NO: 2455 - DNA, 12 bp, Artificial Sequence
  Description of Artificial Sequence: Synthetic oligonucleotide
tcaatcgctttc

SEQ ID NO: 2456 - DNA, 12 bp, Artificial Sequence
  Description of Artificial Sequence: Synthetic oligonucleotide
ttcagaccagcc

SEQ ID NO: 2457 - DNA, 12 bp, Artificial Sequence
  Description of Artificial Sequence: Synthetic oligonucleotide
atctttccctga

SEQ ID NO: 2458 - DNA, 12 bp, Artificial Sequence
  Description of Artificial Sequence: Synthetic oligonucleotide
catatccagccg

SEQ ID NO: 2459 - DNA, 12 bp, Artificial Sequence
  Description of Artificial Sequence: Synthetic oligonucleotide
agacataccgta

SEQ ID NO: 2460 - DNA, 12 bp, Artificial Sequence
  Description of Artificial Sequence: Synthetic oligonucleotide
ctaccgattgcg

SEQ ID NO: 2461 - DNA, 12 bp, Artificial Sequence
  Description of Artificial Sequence: Synthetic oligonucleotide
acgcatcgcact

SEQ ID NO: 2462 - DNA, 12 bp, Artificial Sequence
  Description of Artificial Sequence: Synthetic oligonucleotide
ctccgaacaaca

SEQ ID NO: 2463 - DNA, 12 bp, Artificial Sequence
  Description of Artificial Sequence: Synthetic oligonucleotide
tctcactgttcc

SEQ ID NO: 2464 - DNA, 12 bp, Artificial Sequence
  Description of Artificial Sequence: Synthetic oligonucleotide
gatcctcatgcg

SEQ ID NO: 2465 - DNA, 12 bp, Artificial Sequence
  Description of Artificial Sequence: Synthetic oligonucleotide
tcacccaaggta

SEQ ID NO: 2466 - DNA, 12 bp, Artificial Sequence
  Description of Artificial Sequence: Synthetic oligonucleotide
cagtagcgatat

SEQ ID NO: 2467 - DNA, 12 bp, Artificial Sequence
  Description of Artificial Sequence: Synthetic oligonucleotide
ggtcacacatca

SEQ ID NO: 2468 - DNA, 12 bp, Artificial Sequence
  Description of Artificial Sequence: Synthetic oligonucleotide
gctatggaactc

SEQ ID NO: 2469 - DNA, 12 bp, Artificial Sequence
  Description of Artificial Sequence: Synthetic oligonucleotide
attatcgtccct

SEQ ID NO: 2470 - DNA, 12 bp, Artificial Sequence
  Description of Artificial Sequence: Synthetic oligonucleotide
agccagtcatac

SEQ ID NO: 2471 - DNA, 12 bp, Artificial Sequence
  Description of Artificial Sequence: Synthetic oligonucleotide
ggatactcgcat

SEQ ID NO: 2472 - DNA, 12 bp, Artificial Sequence
  Description of Artificial Sequence: Synthetic oligonucleotide
agaacttgacgt

SEQ ID NO: 2473 - DNA, 12 bp, Artificial Sequence
  Description of Artificial Sequence: Synthetic oligonucleotide
ctccacattcct

SEQ ID NO: 2474 - DNA, 12 bp, Artificial Sequence
  Description of Artificial Sequence: Synthetic oligonucleotide
ccagaccgctat

SEQ ID NO: 2475 - DNA, 12 bp, Artificial Sequence
  Description of Artificial Sequence: Synthetic oligonucleotide
taacggcgctct

SEQ ID NO: 2476 - DNA, 12 bp, Artificial Sequence
  Description of Artificial Sequence: Synthetic oligonucleotide
ctaagttgcaag

SEQ ID NO: 2477 - DNA, 12 bp, Artificial Sequence
  Description of Artificial Sequence: Synthetic oligonucleotide
cttgaacccgac

SEQ ID NO: 2478 - DNA, 12 bp, Artificial Sequence
  Description of Artificial Sequence: Synthetic oligonucleotide
tacgtttggcga

SEQ ID NO: 2479 - DNA, 12 bp, Artificial Sequence
  Description of Artificial Sequence: Synthetic oligonucleotide
agctctagaaac

SEQ ID NO: 2480 - DNA, 12 bp, Artificial Sequence
  Description of Artificial Sequence: Synthetic oligonucleotide
gtttgctcgaga

SEQ ID NO: 2481 - DNA, 12 bp, Artificial Sequence
  Description of Artificial Sequence: Synthetic oligonucleotide
cgcgatatcgtc

SEQ ID NO: 2482 - DNA, 12 bp, Artificial Sequence
  Description of Artificial Sequence: Synthetic oligonucleotide
gacgtgtccatc

SEQ ID NO: 2483 - DNA, 12 bp, Artificial Sequence
  Description of Artificial Sequence: Synthetic oligonucleotide
aatcgcccttgg

SEQ ID NO: 2484 - DNA, 12 bp, Artificial Sequence
  Description of Artificial Sequence: Synthetic oligonucleotide
tccatcgacgtg

SEQ ID NO: 2485 - DNA, 12 bp, Artificial Sequence
  Description of Artificial Sequence: Synthetic oligonucleotide
caaacgcactaa

SEQ ID NO: 2486 - DNA, 12 bp, Artificial Sequence
  Description of Artificial Sequence: Synthetic oligonucleotide
ctgatgtacacg

SEQ ID NO: 2487 - DNA, 12 bp, Artificial Sequence
  Description of Artificial Sequence: Synthetic oligonucleotide
agagccaagagc

SEQ ID NO: 2488 - DNA, 12 bp, Artificial Sequence
  Description of Artificial Sequence: Synthetic oligonucleotide
cggcgatgaaag

SEQ ID NO: 2489 - DNA, 12 bp, Artificial Sequence
  Description of Artificial Sequence: Synthetic oligonucleotide
cgatgtgtggtt

SEQ ID NO: 2490 - DNA, 12 bp, Artificial Sequence
  Description of Artificial Sequence: Synthetic oligonucleotide
gaacaaagagcg

SEQ ID NO: 2491 - DNA, 12 bp, Artificial Sequence
  Description of Artificial Sequence: Synthetic oligonucleotide
aggcatctgctc

SEQ ID NO: 2492 - DNA, 12 bp, Artificial Sequence
  Description of Artificial Sequence: Synthetic oligonucleotide
tgggaatgttgt

SEQ ID NO: 2493 - DNA, 12 bp, Artificial Sequence
  Description of Artificial Sequence: Synthetic oligonucleotide
ccgctacgtgat

SEQ ID NO: 2494 - DNA, 12 bp, Artificial Sequence
  Description of Artificial Sequence: Synthetic oligonucleotide
gcgaagttggga

SEQ ID NO: 2495 - DNA, 12 bp, Artificial Sequence
  Description of Artificial Sequence: Synthetic oligonucleotide
gctaagtgatgt

SEQ ID NO: 2496 - DNA, 12 bp, Artificial Sequence
  Description of Artificial Sequence: Synthetic oligonucleotide
agacctgaccct

SEQ ID NO: 2497 - DNA, 12 bp, Artificial Sequence
  Description of Artificial Sequence: Synthetic oligonucleotide
caatcataggtg

SEQ ID NO: 2498 - DNA, 12 bp, Artificial Sequence
  Description of Artificial Sequence: Synthetic oligonucleotide
ctggtaagtcca

SEQ ID NO: 2499 - DNA, 12 bp, Artificial Sequence
  Description of Artificial Sequence: Synthetic oligonucleotide
gcattcggcgtt

SEQ ID NO: 2500 - DNA, 12 bp, Artificial Sequence
  Description of Artificial Sequence: Synthetic oligonucleotide
aagggacaagtg

SEQ ID NO: 2501 - DNA, 12 bp, Artificial Sequence
  Description of Artificial Sequence: Synthetic oligonucleotide
catcgacgagtt

SEQ ID NO: 2502 - DNA, 12 bp, Artificial Sequence
  Description of Artificial Sequence: Synthetic oligonucleotide
ataagtaaccgc

SEQ ID NO: 2503 - DNA, 12 bp, Artificial Sequence
  Description of Artificial Sequence: Synthetic oligonucleotide
agagctcctctg

SEQ ID NO: 2504 - DNA, 12 bp, Artificial Sequence
  Description of Artificial Sequence: Synthetic oligonucleotide
cgccattgtgca

SEQ ID NO: 2505 - DNA, 12 bp, Artificial Sequence
  Description of Artificial Sequence: Synthetic oligonucleotide
agtgtcgattcg

SEQ ID NO: 2506 - DNA, 12 bp, Artificial Sequence
  Description of Artificial Sequence: Synthetic oligonucleotide
ggagttgaggtg

SEQ ID NO: 2507 - DNA, 12 bp, Artificial Sequence
  Description of Artificial Sequence: Synthetic oligonucleotide
gacttggtaaac

SEQ ID NO: 2508 - DNA, 12 bp, Artificial Sequence
  Description of Artificial Sequence: Synthetic oligonucleotide
gacaaaccttgc

SEQ ID NO: 2509 - DNA, 12 bp, Artificial Sequence
  Description of Artificial Sequence: Synthetic oligonucleotide
tccaactgcaga

SEQ ID NO: 2510 - DNA, 12 bp, Artificial Sequence
  Description of Artificial Sequence: Synthetic oligonucleotide
ctattaagcggc

SEQ ID NO: 2511 - DNA, 12 bp, Artificial Sequence
  Description of Artificial Sequence: Synthetic oligonucleotide
agcatccctaag

SEQ ID NO: 2512 - DNA, 12 bp, Artificial Sequence
  Description of Artificial Sequence: Synthetic oligonucleotide
aatcacggtgct

SEQ ID NO: 2513 - DNA, 12 bp, Artificial Sequence
  Description of Artificial Sequence: Synthetic oligonucleotide
cattagctggaa

SEQ ID NO: 2514 - DNA, 12 bp, Artificial Sequence
  Description of Artificial Sequence: Synthetic oligonucleotide
taaagacccgta

SEQ ID NO: 2515 - DNA, 12 bp, Artificial Sequence
  Description of Artificial Sequence: Synthetic oligonucleotide
cctaccattgtt

SEQ ID NO: 2516 - DNA, 12 bp, Artificial Sequence
  Description of Artificial Sequence: Synthetic oligonucleotide
cagacgaggaac

SEQ ID NO: 2517 - DNA, 12 bp, Artificial Sequence
  Description of Artificial Sequence: Synthetic oligonucleotide
acgacctacgct

SEQ ID NO: 2518 - DNA, 12 bp, Artificial Sequence
  Description of Artificial Sequence: Synthetic oligonucleotide
ccacaacgatca

SEQ ID NO: 2519 - DNA, 12 bp, Artificial Sequence
  Description of Artificial Sequence: Synthetic oligonucleotide
tgtatcttcacc

SEQ ID NO: 2520 - DNA, 12 bp, Artificial Sequence
  Description of Artificial Sequence: Synthetic oligonucleotide
gagtccgttgct

SEQ ID NO: 2521 - DNA, 12 bp, Artificial Sequence
  Description of Artificial Sequence: Synthetic oligonucleotide
tcgctacagatg

SEQ ID NO: 2522 - DNA, 12 bp, Artificial Sequence
  Description of Artificial Sequence: Synthetic oligonucleotide
gatgtcatagcc

SEQ ID NO: 2523 - DNA, 12 bp, Artificial Sequence
  Description of Artificial Sequence: Synthetic oligonucleotide
ccggtgtgattc

SEQ ID NO: 2524 - DNA, 12 bp, Artificial Sequence
  Description of Artificial Sequence: Synthetic oligonucleotide
gactgactcgtc

SEQ ID NO: 2525 - DNA, 12 bp, Artificial Sequence
  Description of Artificial Sequence: Synthetic oligonucleotide
gataactgtacg

SEQ ID NO: 2526 - DNA, 12 bp, Artificial Sequence
  Description of Artificial Sequence: Synthetic oligonucleotide
tcggtgtaccaa

SEQ ID NO: 2527 - DNA, 12 bp, Artificial Sequence
  Description of Artificial Sequence: Synthetic oligonucleotide
tgttgcgtttct

SEQ ID NO: 2528 - DNA, 12 bp, Artificial Sequence
  Description of Artificial Sequence: Synthetic oligonucleotide
atagtgttcggc

SEQ ID NO: 2529 - DNA, 12 bp, Artificial Sequence
  Description of Artificial Sequence: Synthetic oligonucleotide
tcgtggatagct

SEQ ID NO: 2530 - DNA, 12 bp, Artificial Sequence
  Description of Artificial Sequence: Synthetic oligonucleotide
taaacctggaca

SEQ ID NO: 2531 - DNA, 12 bp, Artificial Sequence
  Description of Artificial Sequence: Synthetic oligonucleotide
aacacggtttga

SEQ ID NO: 2532 - DNA, 12 bp, Artificial Sequence
  Description of Artificial Sequence: Synthetic oligonucleotide
gcatactacagc

SEQ ID NO: 2533 - DNA, 12 bp, Artificial Sequence
  Description of Artificial Sequence: Synthetic oligonucleotide
taatctcgccgg

SEQ ID NO: 2534 - DNA, 12 bp, Artificial Sequence
  Description of Artificial Sequence: Synthetic oligonucleotide
gacgcactaact

SEQ ID NO: 2535 - DNA, 12 bp, Artificial Sequence
  Description of Artificial Sequence: Synthetic oligonucleotide
ccgaattgacaa

SEQ ID NO: 2536 - DNA, 12 bp, Artificial Sequence
  Description of Artificial Sequence: Synthetic oligonucleotide
cttgtgcgacaa

SEQ ID NO: 2537 - DNA, 12 bp, Artificial Sequence
  Description of Artificial Sequence: Synthetic oligonucleotide
gaggtattctga

SEQ ID NO: 2538 - DNA, 12 bp, Artificial Sequence
  Description of Artificial Sequence: Synthetic oligonucleotide
cagatcccaacc

SEQ ID NO: 2539 - DNA, 12 bp, Artificial Sequence
  Description of Artificial Sequence: Synthetic oligonucleotide
ggcgatttacgt

SEQ ID NO: 2540 - DNA, 12 bp, Artificial Sequence
  Description of Artificial Sequence: Synthetic oligonucleotide
ctggcatctagc

SEQ ID NO: 2541 - DNA, 12 bp, Artificial Sequence
  Description of Artificial Sequence: Synthetic oligonucleotide
agagtaagccgg

SEQ ID NO: 2542 - DNA, 12 bp, Artificial Sequence
  Description of Artificial Sequence: Synthetic oligonucleotide
atgttcctcatc

SEQ ID NO: 2543 - DNA, 12 bp, Artificial Sequence
  Description of Artificial Sequence: Synthetic oligonucleotide
agagattatgcc

SEQ ID NO: 2544 - DNA, 12 bp, Artificial Sequence
  Description of Artificial Sequence: Synthetic oligonucleotide
taaggcatcgct

SEQ ID NO: 2545 - DNA, 12 bp, Artificial Sequence
  Description of Artificial Sequence: Synthetic oligonucleotide
ggtggtcgttct

SEQ ID NO: 2546 - DNA, 12 bp, Artificial Sequence
  Description of Artificial Sequence: Synthetic oligonucleotide
agacaccaatgt

SEQ ID NO: 2547 - DNA, 12 bp, Artificial Sequence
  Description of Artificial Sequence: Synthetic oligonucleotide
cggtatagcaat

SEQ ID NO: 2548 - DNA, 12 bp, Artificial Sequence
  Description of Artificial Sequence: Synthetic oligonucleotide
tgaatacctggc

SEQ ID NO: 2549 - DNA, 12 bp, Artificial Sequence
  Description of Artificial Sequence: Synthetic oligonucleotide
acccatacagcc

SEQ ID NO: 2550 - DNA, 12 bp, Artificial Sequence
  Description of Artificial Sequence: Synthetic oligonucleotide
actatgggctaa

SEQ ID NO: 2551 - DNA, 12 bp, Artificial Sequence
  Description of Artificial Sequence: Synthetic oligonucleotide
aatacgtcaagc

SEQ ID NO: 2552 - DNA, 12 bp, Artificial Sequence
  Description of Artificial Sequence: Synthetic oligonucleotide
cttggcctgtag

SEQ ID NO: 2553 - DNA, 12 bp, Artificial Sequence
  Description of Artificial Sequence: Synthetic oligonucleotide
ctcccactagag

SEQ ID NO: 2554 - DNA, 12 bp, Artificial Sequence
  Description of Artificial Sequence: Synthetic oligonucleotide
cgcactacgcat

SEQ ID NO: 2555 - DNA, 12 bp, Artificial Sequence
  Description of Artificial Sequence: Synthetic oligonucleotide
gcattgagttcg

SEQ ID NO: 2556 - DNA, 12 bp, Artificial Sequence
  Description of Artificial Sequence: Synthetic oligonucleotide
atggcaattcag

SEQ ID NO: 2557 - DNA, 12 bp, Artificial Sequence
  Description of Artificial Sequence: Synthetic oligonucleotide
atcaaacgcatg

SEQ ID NO: 2558 - DNA, 12 bp, Artificial Sequence
  Description of Artificial Sequence: Synthetic oligonucleotide
agccctgctaca

SEQ ID NO: 2559 - DNA, 12 bp, Artificial Sequence
  Description of Artificial Sequence: Synthetic oligonucleotide
cagtcgttaaga

SEQ ID NO: 2560 - DNA, 12 bp, Artificial Sequence
  Description of Artificial Sequence: Synthetic oligonucleotide
gttgctgagtcc

SEQ ID NO: 2561 - DNA, 12 bp, Artificial Sequence
  Description of Artificial Sequence: Synthetic oligonucleotide
cagtgtcatgaa

SEQ ID NO: 2562 - DNA, 12 bp, Artificial Sequence
  Description of Artificial Sequence: Synthetic oligonucleotide
cggtcctgagtt

SEQ ID NO: 2563 - DNA, 12 bp, Artificial Sequence
  Description of Artificial Sequence: Synthetic oligonucleotide
ccttatagaagg

SEQ ID NO: 2564 - DNA, 12 bp, Artificial Sequence
  Description of Artificial Sequence: Synthetic oligonucleotide
ctacgaaagcct

SEQ ID NO: 2565 - DNA, 12 bp, Artificial Sequence
  Description of Artificial Sequence: Synthetic oligonucleotide
ctatggtgaacc

SEQ ID NO: 2566 - DNA, 12 bp, Artificial Sequence
  Description of Artificial Sequence: Synthetic oligonucleotide
cggtgacctact

SEQ ID NO: 2567 - DNA, 12 bp, Artificial Sequence
  Description of Artificial Sequence: Synthetic oligonucleotide
ctcgagcgtact

SEQ ID NO: 2568 - DNA, 12 bp, Artificial Sequence
  Description of Artificial Sequence: Synthetic oligonucleotide
ggccaaggaagt

SEQ ID NO: 2569 - DNA, 12 bp, Artificial Sequence
  Description of Artificial Sequence: Synthetic oligonucleotide
ataattgccgag

SEQ ID NO: 2570 - DNA, 12 bp, Artificial Sequence
  Description of Artificial Sequence: Synthetic oligonucleotide
ggaccaagggat

SEQ ID NO: 2571 - DNA, 12 bp, Artificial Sequence
  Description of Artificial Sequence: Synthetic oligonucleotide
acatccctactt

SEQ ID NO: 2572 - DNA, 12 bp, Artificial Sequence
  Description of Artificial Sequence: Synthetic oligonucleotide
ttaaggactgac

SEQ ID NO: 2573 - DNA, 12 bp, Artificial Sequence
  Description of Artificial Sequence: Synthetic oligonucleotide
cctctactctaa

SEQ ID NO: 2574 - DNA, 12 bp, Artificial Sequence
  Description of Artificial Sequence: Synthetic oligonucleotide
ggcatgttatcg

SEQ ID NO: 2575 - DNA, 12 bp, Artificial Sequence
  Description of Artificial Sequence: Synthetic oligonucleotide
gtattggtcaga

SEQ ID NO: 2576 - DNA, 12 bp, Artificial Sequence
  Description of Artificial Sequence: Synthetic oligonucleotide
tgaagcacacta

SEQ ID NO: 2577 - DNA, 12 bp, Artificial Sequence
  Description of Artificial Sequence: Synthetic oligonucleotide
gtggaagagaca

SEQ ID NO: 2578 - DNA, 12 bp, Artificial Sequence
  Description of Artificial Sequence: Synthetic oligonucleotide
gagtcgatcttg

SEQ ID NO: 2579 - DNA, 12 bp, Artificial Sequence
  Description of Artificial Sequence: Synthetic oligonucleotide
aggcacagtagg

SEQ ID NO: 2580 - DNA, 12 bp, Artificial Sequence
  Description of Artificial Sequence: Synthetic oligonucleotide
agaaccgtcata

SEQ ID NO: 2581 - DNA, 12 bp, Artificial Sequence
  Description of Artificial Sequence: Synthetic oligonucleotide
gtgaatgttcga

SEQ ID NO: 2582 - DNA, 12 bp, Artificial Sequence
  Description of Artificial Sequence: Synthetic oligonucleotide
taactaggacgt

SEQ ID NO: 2583 - DNA, 12 bp, Artificial Sequence
  Description of Artificial Sequence: Synthetic oligonucleotide
gacctaccgcat

SEQ ID NO: 2584 - DNA, 12 bp, Artificial Sequence
  Description of Artificial Sequence: Synthetic oligonucleotide
ctacttacatcc

SEQ ID NO: 2585 - DNA, 12 bp, Artificial Sequence
  Description of Artificial Sequence: Synthetic oligonucleotide
aactggaaccct

SEQ ID NO: 2586 - DNA, 12 bp, Artificial Sequence
  Description of Artificial Sequence: Synthetic oligonucleotide
agtcgctacaca

SEQ ID NO: 2587 - DNA, 12 bp, Artificial Sequence
  Description of Artificial Sequence: Synthetic oligonucleotide
gaaagagtctct

SEQ ID NO: 2588 - DNA, 12 bp, Artificial Sequence
  Description of Artificial Sequence: Synthetic oligonucleotide
atgtaataggcc

SEQ ID NO: 2589 - DNA, 12 bp, Artificial Sequence
  Description of Artificial Sequence: Synthetic oligonucleotide
ctcttctgatca

SEQ ID NO: 2590 - DNA, 12 bp, Artificial Sequence
  Description of Artificial Sequence: Synthetic oligonucleotide
atactcggctgc

SEQ ID NO: 2591 - DNA, 12 bp, Artificial Sequence
  Description of Artificial Sequence: Synthetic oligonucleotide
aaccactaaccg

SEQ ID NO: 2592 - DNA, 12 bp, Artificial Sequence
  Description of Artificial Sequence: Synthetic oligonucleotide
tcaccggaatcc

SEQ ID NO: 2593 - DNA, 12 bp, Artificial Sequence
  Description of Artificial Sequence: Synthetic oligonucleotide
gactcgcaacta

SEQ ID NO: 2594 - DNA, 12 bp, Artificial Sequence
  Description of Artificial Sequence: Synthetic oligonucleotide
atgctaaccacg

SEQ ID NO: 2595 - DNA, 12 bp, Artificial Sequence
  Description of Artificial Sequence: Synthetic oligonucleotide
acgcttaacgac

SEQ ID NO: 2596 - DNA, 12 bp, Artificial Sequence
  Description of Artificial Sequence: Synthetic oligonucleotide
ttcgctaacctt

SEQ ID NO: 2597 - DNA, 12 bp, Artificial Sequence
  Description of Artificial Sequence: Synthetic oligonucleotide
cgactgcagctt

SEQ ID NO: 2598 - DNA, 12 bp, Artificial Sequence
  Description of Artificial Sequence: Synthetic oligonucleotide
ctgacgatccgt

SEQ ID NO: 2599 - DNA, 12 bp, Artificial Sequence
  Description of Artificial Sequence: Synthetic oligonucleotide
accaatctcggc

SEQ ID NO: 2600 - DNA, 12 bp, Artificial Sequence
  Description of Artificial Sequence: Synthetic oligonucleotide
agcttaccgacc

SEQ ID NO: 2601 - DNA, 12 bp, Artificial Sequence
  Description of Artificial Sequence: Synthetic oligonucleotide
gacactcaccgt

SEQ ID NO: 2602 - DNA, 12 bp, Artificial Sequence
  Description of Artificial Sequence: Synthetic oligonucleotide
gttacccgagct

SEQ ID NO: 2603 - DNA, 12 bp, Artificial Sequence
  Description of Artificial Sequence: Synthetic oligonucleotide
gtgcgaggacaa

SEQ ID NO: 2604 - DNA, 12 bp, Artificial Sequence
  Description of Artificial Sequence: Synthetic oligonucleotide
tatccaagcgca

SEQ ID NO: 2605 - DNA, 12 bp, Artificial Sequence
  Description of Artificial Sequence: Synthetic oligonucleotide
agggctatagtt

SEQ ID NO: 2606 - DNA, 12 bp, Artificial Sequence
  Description of Artificial Sequence: Synthetic oligonucleotide
tcagagtagact

SEQ ID NO: 2607 - DNA, 12 bp, Artificial Sequence
  Description of Artificial Sequence: Synthetic oligonucleotide
cctaggtcccaa

SEQ ID NO: 2608 - DNA, 12 bp, Artificial Sequence
  Description of Artificial Sequence: Synthetic oligonucleotide
gcagagaggcta

SEQ ID NO: 2609 - DNA, 12 bp, Artificial Sequence
  Description of Artificial Sequence: Synthetic oligonucleotide
gtactgaagatc

SEQ ID NO: 2610 - DNA, 12 bp, Artificial Sequence
  Description of Artificial Sequence: Synthetic oligonucleotide
tgtctcgcaagc

SEQ ID NO: 2611 - DNA, 12 bp, Artificial Sequence
  Description of Artificial Sequence: Synthetic oligonucleotide
gaccaaatgtcc

SEQ ID NO: 2612 - DNA, 12 bp, Artificial Sequence
  Description of Artificial Sequence: Synthetic oligonucleotide
ttgagtggtctg

SEQ ID NO: 2613 - DNA, 12 bp, Artificial Sequence
  Description of Artificial Sequence: Synthetic oligonucleotide
tccttgtccttg

SEQ ID NO: 2614 - DNA, 12 bp, Artificial Sequence
  Description of Artificial Sequence: Synthetic oligonucleotide
tcgccgtgtaca

SEQ ID NO: 2615 - DNA, 12 bp, Artificial Sequence
  Description of Artificial Sequence: Synthetic oligonucleotide
cagccgcatatc

SEQ ID NO: 2616 - DNA, 12 bp, Artificial Sequence
  Description of Artificial Sequence: Synthetic oligonucleotide
gatgcaacttcg

SEQ ID NO: 2617 - DNA, 12 bp, Artificial Sequence
  Description of Artificial Sequence: Synthetic oligonucleotide
cgacgagattat

SEQ ID NO: 2618 - DNA, 12 bp, Artificial Sequence
  Description of Artificial Sequence: Synthetic oligonucleotide
ctacaattgagg

SEQ ID NO: 2619 - DNA, 12 bp, Artificial Sequence
  Description of Artificial Sequence: Synthetic oligonucleotide
aactgcgatatg

SEQ ID NO: 2620 - DNA, 12 bp, Artificial Sequence
  Description of Artificial Sequence: Synthetic oligonucleotide
gatacgttcgca

SEQ ID NO: 2621 - DNA, 12 bp, Artificial Sequence
  Description of Artificial Sequence: Synthetic oligonucleotide
caccacagaatc

SEQ ID NO: 2622 - DNA, 12 bp, Artificial Sequence
  Description of Artificial Sequence: Synthetic oligonucleotide
agtactgcctgc

SEQ ID NO: 2623 - DNA, 12 bp, Artificial Sequence
  Description of Artificial Sequence: Synthetic oligonucleotide
gttgaccatcgc

SEQ ID NO: 2624 - DNA, 12 bp, Artificial Sequence
  Description of Artificial Sequence: Synthetic oligonucleotide
cttccaactcat

SEQ ID NO: 2625 - DNA, 12 bp, Artificial Sequence
  Description of Artificial Sequence: Synthetic oligonucleotide
ccaagattcgcc

SEQ ID NO: 2626 - DNA, 12 bp, Artificial Sequence
  Description of Artificial Sequence: Synthetic oligonucleotide
ggagctctgtat

SEQ ID NO: 2627 - DNA, 12 bp, Artificial Sequence
  Description of Artificial Sequence: Synthetic oligonucleotide
gaagtccacact

SEQ ID NO: 2628 - DNA, 12 bp, Artificial Sequence
  Description of Artificial Sequence: Synthetic oligonucleotide
caatgagggaga

SEQ ID NO: 2629 - DNA, 12 bp, Artificial Sequence
  Description of Artificial Sequence: Synthetic oligonucleotide
gagatcgcctat

SEQ ID NO: 2630 - DNA, 12 bp, Artificial Sequence
  Description of Artificial Sequence: Synthetic oligonucleotide
gaggctgattta

SEQ ID NO: 2631 - DNA, 12 bp, Artificial Sequence
  Description of Artificial Sequence: Synthetic oligonucleotide
ccttaagggcat

SEQ ID NO: 2632 - DNA, 12 bp, Artificial Sequence
  Description of Artificial Sequence: Synthetic oligonucleotide
gtagaatgctcc

SEQ ID NO: 2633 - DNA, 12 bp, Artificial Sequence
  Description of Artificial Sequence: Synthetic oligonucleotide
aagcaacggtgg

SEQ ID NO: 2634 - DNA, 12 bp, Artificial Sequence
  Description of Artificial Sequence: Synthetic oligonucleotide
tgtacatcgccg

SEQ ID NO: 2635 - DNA, 12 bp, Artificial Sequence
  Description of Artificial Sequence: Synthetic oligonucleotide
gagttagcatca

SEQ ID NO: 2636 - DNA, 12 bp, Artificial Sequence
  Description of Artificial Sequence: Synthetic oligonucleotide
gctgctacaagt

SEQ ID NO: 2637 - DNA, 12 bp, Artificial Sequence
  Description of Artificial Sequence: Synthetic oligonucleotide
acaccctatcgg

SEQ ID NO: 2638 - DNA, 12 bp, Artificial Sequence
  Description of Artificial Sequence: Synthetic oligonucleotide
ctccaatgacgc

SEQ ID NO: 2639 - DNA, 12 bp, Artificial Sequence
  Description of Artificial Sequence: Synthetic oligonucleotide
tgttaagcagca

SEQ ID NO: 2640 - DNA, 12 bp, Artificial Sequence
  Description of Artificial Sequence: Synthetic oligonucleotide
tgtagtataggc

SEQ ID NO: 2641 - DNA, 12 bp, Artificial Sequence
  Description of Artificial Sequence: Synthetic oligonucleotide
gtaaacgacttg

SEQ ID NO: 2642 - DNA, 12 bp, Artificial Sequence
  Description of Artificial Sequence: Synthetic oligonucleotide
aggaggataaag

SEQ ID NO: 2643 - DNA, 12 bp, Artificial Sequence
  Description of Artificial Sequence: Synthetic oligonucleotide
atggaaggtggc

SEQ ID NO: 2644 - DNA, 12 bp, Artificial Sequence
  Description of Artificial Sequence: Synthetic oligonucleotide
acggcgttatgt

SEQ ID NO: 2645 - DNA, 12 bp, Artificial Sequence
  Description of Artificial Sequence: Synthetic oligonucleotide
ctcacgcaatgc

SEQ ID NO: 2646 - DNA, 12 bp, Artificial Sequence
  Description of Artificial Sequence: Synthetic oligonucleotide
cgccctcttctt

SEQ ID NO: 2647 - DNA, 12 bp, Artificial Sequence
  Description of Artificial Sequence: Synthetic oligonucleotide
gcatgggttatc

SEQ ID NO: 2648 - DNA, 12 bp, Artificial Sequence
  Description of Artificial Sequence: Synthetic oligonucleotide
ccggcttatgtg

SEQ ID NO: 2649 - DNA, 12 bp, Artificial Sequence
  Description of Artificial Sequence: Synthetic oligonucleotide
actttgctttgc

SEQ ID NO: 2650 - DNA, 12 bp, Artificial Sequence
  Description of Artificial Sequence: Synthetic oligonucleotide
gtcccgtgaaat

SEQ ID NO: 2651 - DNA, 12 bp, Artificial Sequence
  Description of Artificial Sequence: Synthetic oligonucleotide
actagacgacta

SEQ ID NO: 2652 - DNA, 12 bp, Artificial Sequence
  Description of Artificial Sequence: Synthetic oligonucleotide
gttcccaacggt

SEQ ID NO: 2653 - DNA, 12 bp, Artificial Sequence
  Description of Artificial Sequence: Synthetic oligonucleotide
ctgtgcaacgtc

SEQ ID NO: 2654 - DNA, 12 bp, Artificial Sequence
  Description of Artificial Sequence: Synthetic oligonucleotide
caaagcggtatt

SEQ ID NO: 2655 - DNA, 12 bp, Artificial Sequence
  Description of Artificial Sequence: Synthetic oligonucleotide
ggacagtgtatt

SEQ ID NO: 2656 - DNA, 12 bp, Artificial Sequence
  Description of Artificial Sequence: Synthetic oligonucleotide
aggttaagtgct

SEQ ID NO: 2657 - DNA, 12 bp, Artificial Sequence
  Description of Artificial Sequence: Synthetic oligonucleotide
gtcagagtattg

SEQ ID NO: 2658 - DNA, 12 bp, Artificial Sequence
  Description of Artificial Sequence: Synthetic oligonucleotide
agtcaatggcct

SEQ ID NO: 2659 - DNA, 12 bp, Artificial Sequence
  Description of Artificial Sequence: Synthetic oligonucleotide
cgaaactacgta

SEQ ID NO: 2660 - DNA, 12 bp, Artificial Sequence
  Description of Artificial Sequence: Synthetic oligonucleotide
acacgactatag

SEQ ID NO: 2661 - DNA, 12 bp, Artificial Sequence
  Description of Artificial Sequence: Synthetic oligonucleotide
atatcctgggac

SEQ ID NO: 2662 - DNA, 12 bp, Artificial Sequence
  Description of Artificial Sequence: Synthetic oligonucleotide
atgacagaacct

SEQ ID NO: 2663 - DNA, 12 bp, Artificial Sequence
  Description of Artificial Sequence: Synthetic oligonucleotide
ggaacacatgtt

SEQ ID NO: 2664 - DNA, 12 bp, Artificial Sequence
  Description of Artificial Sequence: Synthetic oligonucleotide
gaggaccagcaa

SEQ ID NO: 2665 - DNA, 12 bp, Artificial Sequence
  Description of Artificial Sequence: Synthetic oligonucleotide
gtgtaggtgctt

SEQ ID NO: 2666 - DNA, 12 bp, Artificial Sequence
  Description of Artificial Sequence: Synthetic oligonucleotide
ttgtagccgaca

SEQ ID NO: 2667 - DNA, 12 bp, Artificial Sequence
  Description of Artificial Sequence: Synthetic oligonucleotide
acaagtgctgct

SEQ ID NO: 2668 - DNA, 12 bp, Artificial Sequence
  Description of Artificial Sequence: Synthetic oligonucleotide
agcgcatatcca

SEQ ID NO: 2669 - DNA, 12 bp, Artificial Sequence
  Description of Artificial Sequence: Synthetic oligonucleotide
aatagcatgtcg

SEQ ID NO: 2670 - DNA, 12 bp, Artificial Sequence
  Description of Artificial Sequence: Synthetic oligonucleotide
tgaactagcgtc

SEQ ID NO: 2671 - DNA, 12 bp, Artificial Sequence
  Description of Artificial Sequence: Synthetic oligonucleotide
tcagaagctcaa

SEQ ID NO: 2672 - DNA, 12 bp, Artificial Sequence
  Description of Artificial Sequence: Synthetic oligonucleotide
aatagtcgtgac

SEQ ID NO: 2673 - DNA, 12 bp, Artificial Sequence
  Description of Artificial Sequence: Synthetic oligonucleotide
tgcaacttgcag

SEQ ID NO: 2674 - DNA, 12 bp, Artificial Sequence
  Description of Artificial Sequence: Synthetic oligonucleotide
cggagtaatcct

SEQ ID NO: 2675 - DNA, 12 bp, Artificial Sequence
  Description of Artificial Sequence: Synthetic oligonucleotide
tccgagtcacca

SEQ ID NO: 2676 - DNA, 12 bp, Artificial Sequence
  Description of Artificial Sequence: Synthetic oligonucleotide
actgtgacgtcc

SEQ ID NO: 2677 - DNA, 12 bp, Artificial Sequence
  Description of Artificial Sequence: Synthetic oligonucleotide
tacaagtggtcc

SEQ ID NO: 2678 - DNA, 12 bp, Artificial Sequence
  Description of Artificial Sequence: Synthetic oligonucleotide
gtgtggcagaag

SEQ ID NO: 2679 - DNA, 12 bp, Artificial Sequence
  Description of Artificial Sequence: Synthetic oligonucleotide
ctgtgtccatgg

SEQ ID NO: 2680 - DNA, 12 bp, Artificial Sequence
  Description of Artificial Sequence: Synthetic oligonucleotide
tcctctttggtc

SEQ ID NO: 2681 - DNA, 12 bp, Artificial Sequence
  Description of Artificial Sequence: Synthetic oligonucleotide
ttgcagtgcaac

SEQ ID NO: 2682 - DNA, 12 bp, Artificial Sequence
  Description of Artificial Sequence: Synthetic oligonucleotide
gctggtctagtc

SEQ ID NO: 2683 - DNA, 12 bp, Artificial Sequence
  Description of Artificial Sequence: Synthetic oligonucleotide
gtgaccctgtca

SEQ ID NO: 2684 - DNA, 12 bp, Artificial Sequence
  Description of Artificial Sequence: Synthetic oligonucleotide
cttcgcggatgt

SEQ ID NO: 2685 - DNA, 12 bp, Artificial Sequence
  Description of Artificial Sequence: Synthetic oligonucleotide
tccaccctctat

SEQ ID NO: 2686 - DNA, 12 bp, Artificial Sequence
  Description of Artificial Sequence: Synthetic oligonucleotide
tgtcatggctga

SEQ ID NO: 2687 - DNA, 12 bp, Artificial Sequence
  Description of Artificial Sequence: Synthetic oligonucleotide
ggcatcctggtt

SEQ ID NO: 2688 - DNA, 12 bp, Artificial Sequence
  Description of Artificial Sequence: Synthetic oligonucleotide
cacgcagtctac

SEQ ID NO: 2689 - DNA, 12 bp, Artificial Sequence
  Description of Artificial Sequence: Synthetic oligonucleotide
ataggctgtagt

SEQ ID NO: 2690 - DNA, 12 bp, Artificial Sequence
  Description of Artificial Sequence: Synthetic oligonucleotide
tcgtgacgctaa

SEQ ID NO: 2691 - DNA, 12 bp, Artificial Sequence
  Description of Artificial Sequence: Synthetic oligonucleotide
ttcgtgaggata

SEQ ID NO: 2692 - DNA, 12 bp, Artificial Sequence
  Description of Artificial Sequence: Synthetic oligonucleotide
gtgcctcaggtt

SEQ ID NO: 2693 - DNA, 12 bp, Artificial Sequence
  Description of Artificial Sequence: Synthetic oligonucleotide
ttcactgtgcgg

SEQ ID NO: 2694 - DNA, 12 bp, Artificial Sequence
  Description of Artificial Sequence: Synthetic oligonucleotide
tgtgtagccatg

SEQ ID NO: 2695 - DNA, 12 bp, Artificial Sequence
  Description of Artificial Sequence: Synthetic oligonucleotide
acggctagttcc

SEQ ID NO: 2696 - DNA, 12 bp, Artificial Sequence
  Description of Artificial Sequence: Synthetic oligonucleotide
tcccaacctagg

SEQ ID NO: 2697 - DNA, 12 bp, Artificial Sequence
  Description of Artificial Sequence: Synthetic oligonucleotide
attacagcgaca

SEQ ID NO: 2698 - DNA, 12 bp, Artificial Sequence
  Description of Artificial Sequence: Synthetic oligonucleotide
aacgaataccac

SEQ ID NO: 2699 - DNA, 12 bp, Artificial Sequence
  Description of Artificial Sequence: Synthetic oligonucleotide
aagggcgctgaa

SEQ ID NO: 2700 - DNA, 12 bp, Artificial Sequence
  Description of Artificial Sequence: Synthetic oligonucleotide
gcactggcatat

SEQ ID NO: 2701 - DNA, 12 bp, Artificial Sequence
  Description of Artificial Sequence: Synthetic oligonucleotide
tagaatcaacgc

SEQ ID NO: 2702 - DNA, 12 bp, Artificial Sequence
  Description of Artificial Sequence: Synthetic oligonucleotide
atgcagagatct

SEQ ID NO: 2703 - DNA, 12 bp, Artificial Sequence
  Description of Artificial Sequence: Synthetic oligonucleotide
atggttcacccg

SEQ ID NO: 2704 - DNA, 12 bp, Artificial Sequence
  Description of Artificial Sequence: Synthetic oligonucleotide
gtttccgtggtg

SEQ ID NO: 2705 - DNA, 12 bp, Artificial Sequence
  Description of Artificial Sequence: Synthetic oligonucleotide
ggcattagttga

SEQ ID NO: 2706 - DNA, 12 bp, Artificial Sequence
  Description of Artificial Sequence: Synthetic oligonucleotide
cacaatacaccg

SEQ ID NO: 2707 - DNA, 12 bp, Artificial Sequence
  Description of Artificial Sequence: Synthetic oligonucleotide
cgtatgccgtac

SEQ ID NO: 2708 - DNA, 12 bp, Artificial Sequence
  Description of Artificial Sequence: Synthetic oligonucleotide
tagcggaagacg

SEQ ID NO: 2709 - DNA, 12 bp, Artificial Sequence
  Description of Artificial Sequence: Synthetic oligonucleotide
aggaaccagacg

SEQ ID NO: 2710 - DNA, 12 bp, Artificial Sequence
  Description of Artificial Sequence: Synthetic oligonucleotide
cggtagttgatc

SEQ ID NO: 2711 - DNA, 12 bp, Artificial Sequence
  Description of Artificial Sequence: Synthetic oligonucleotide
gtatgactagca

SEQ ID NO: 2712 - DNA, 12 bp, Artificial Sequence
  Description of Artificial Sequence: Synthetic oligonucleotide
agccgactctgt

SEQ ID NO: 2713 - DNA, 12 bp, Artificial Sequence
  Description of Artificial Sequence: Synthetic oligonucleotide
cctcatgctatt

SEQ ID NO: 2714 - DNA, 12 bp, Artificial Sequence
  Description of Artificial Sequence: Synthetic oligonucleotide
taatgcccaggt

SEQ ID NO: 2715 - DNA, 12 bp, Artificial Sequence
  Description of Artificial Sequence: Synthetic oligonucleotide
tgaaagcggcga

SEQ ID NO: 2716 - DNA, 12 bp, Artificial Sequence
  Description of Artificial Sequence: Synthetic oligonucleotide
atgctctagaga

SEQ ID NO: 2717 - DNA, 12 bp, Artificial Sequence
  Description of Artificial Sequence: Synthetic oligonucleotide
ctattcttggct

SEQ ID NO: 2718 - DNA, 12 bp, Artificial Sequence
  Description of Artificial Sequence: Synthetic oligonucleotide
ccatcttaccat

SEQ ID NO: 2719 - DNA, 12 bp, Artificial Sequence
  Description of Artificial Sequence: Synthetic oligonucleotide
tatgaacgtccg

SEQ ID NO: 2720 - DNA, 12 bp, Artificial Sequence
  Description of Artificial Sequence: Synthetic oligonucleotide
ggttacggttac

SEQ ID NO: 2721 - DNA, 12 bp, Artificial Sequence
  Description of Artificial Sequence: Synthetic oligonucleotide
agctagcgttca

SEQ ID NO: 2722 - DNA, 12 bp, Artificial Sequence
  Description of Artificial Sequence: Synthetic oligonucleotide
tcggtagcaact

SEQ ID NO: 2723 - DNA, 12 bp, Artificial Sequence
  Description of Artificial Sequence: Synthetic oligonucleotide
tatgctctctca

SEQ ID NO: 2724 - DNA, 12 bp, Artificial Sequence
  Description of Artificial Sequence: Synthetic oligonucleotide
ccacattgggtc

SEQ ID NO: 2725 - DNA, 12 bp, Artificial Sequence
  Description of Artificial Sequence: Synthetic oligonucleotide
acatcaggtcac

SEQ ID NO: 2726 - DNA, 12 bp, Artificial Sequence
  Description of Artificial Sequence: Synthetic oligonucleotide
ggtcttagcacc

SEQ ID NO: 2727 - DNA, 12 bp, Artificial Sequence
  Description of Artificial Sequence: Synthetic oligonucleotide
ccaaatgatgac

SEQ ID NO: 2728 - DNA, 12 bp, Artificial Sequence
  Description of Artificial Sequence: Synthetic oligonucleotide
cgtgtagtagat

SEQ ID NO: 2729 - DNA, 12 bp, Artificial Sequence
  Description of Artificial Sequence: Synthetic oligonucleotide
tcagtcagatga

SEQ ID NO: 2730 - DNA, 12 bp, Artificial Sequence
  Description of Artificial Sequence: Synthetic oligonucleotide
gttgatacgatg

SEQ ID NO: 2731 - DNA, 12 bp, Artificial Sequence
  Description of Artificial Sequence: Synthetic oligonucleotide
taccatccatct

SEQ ID NO: 2732 - DNA, 12 bp, Artificial Sequence
  Description of Artificial Sequence: Synthetic oligonucleotide
gcaggtaacatt

SEQ ID NO: 2733 - DNA, 12 bp, Artificial Sequence
  Description of Artificial Sequence: Synthetic oligonucleotide
acatgggcggaa

SEQ ID NO: 2734 - DNA, 12 bp, Artificial Sequence
  Description of Artificial Sequence: Synthetic oligonucleotide
aagtcacacaca

SEQ ID NO: 2735 - DNA, 12 bp, Artificial Sequence
  Description of Artificial Sequence: Synthetic oligonucleotide
cagacacttccg

SEQ ID NO: 2736 - DNA, 12 bp, Artificial Sequence
  Description of Artificial Sequence: Synthetic oligonucleotide
agggatggacca

SEQ ID NO: 2737 - DNA, 12 bp, Artificial Sequence
  Description of Artificial Sequence: Synthetic oligonucleotide
gcacgttctacg

SEQ ID NO: 2738 - DNA, 12 bp, Artificial Sequence
  Description of Artificial Sequence: Synthetic oligonucleotide
ccgctgatgtca

SEQ ID NO: 2739 - DNA, 12 bp, Artificial Sequence
  Description of Artificial Sequence: Synthetic oligonucleotide
gctgtgattcga

SEQ ID NO: 2740 - DNA, 12 bp, Artificial Sequence
  Description of Artificial Sequence: Synthetic oligonucleotide
tcaccatccgag

SEQ ID NO: 2741 - DNA, 12 bp, Artificial Sequence
  Description of Artificial Sequence: Synthetic oligonucleotide
actaatacgcga

SEQ ID NO: 2742 - DNA, 12 bp, Artificial Sequence
  Description of Artificial Sequence: Synthetic oligonucleotide
gactggagatgg

SEQ ID NO: 2743 - DNA, 12 bp, Artificial Sequence
  Description of Artificial Sequence: Synthetic oligonucleotide
acgagtttaccg

SEQ ID NO: 2744 - DNA, 12 bp, Artificial Sequence
  Description of Artificial Sequence: Synthetic oligonucleotide
ctagctatggac

SEQ ID NO: 2745 - DNA, 12 bp, Artificial Sequence
  Description of Artificial Sequence: Synthetic oligonucleotide
acccaccactag

SEQ ID NO: 2746 - DNA, 12 bp, Artificial Sequence
  Description of Artificial Sequence: Synthetic oligonucleotide
tcatacagccag

SEQ ID NO: 2747 - DNA, 12 bp, Artificial Sequence
  Description of Artificial Sequence: Synthetic oligonucleotide
actaagtacccg

SEQ ID NO: 2748 - DNA, 12 bp, Artificial Sequence
  Description of Artificial Sequence: Synthetic oligonucleotide
ggagattggaga

SEQ ID NO: 2749 - DNA, 12 bp, Artificial Sequence
  Description of Artificial Sequence: Synthetic oligonucleotide
cttgacgaggtt

SEQ ID NO: 2750 - DNA, 12 bp, Artificial Sequence
  Description of Artificial Sequence: Synthetic oligonucleotide
cagaaggtgtgg

SEQ ID NO: 2751 - DNA, 12 bp, Artificial Sequence
  Description of Artificial Sequence: Synthetic oligonucleotide
ggaggccataag

SEQ ID NO: 2752 - DNA, 12 bp, Artificial Sequence
  Description of Artificial Sequence: Synthetic oligonucleotide
taagtgagtacc

SEQ ID NO: 2753 - DNA, 12 bp, Artificial Sequence
  Description of Artificial Sequence: Synthetic oligonucleotide
aagcccagcatt

SEQ ID NO: 2754 - DNA, 12 bp, Artificial Sequence
  Description of Artificial Sequence: Synthetic oligonucleotide
acctgggaatat

SEQ ID NO: 2755 - DNA, 12 bp, Artificial Sequence
  Description of Artificial Sequence: Synthetic oligonucleotide
gaagcttgaatc

SEQ ID NO: 2756 - DNA, 12 bp, Artificial Sequence
  Description of Artificial Sequence: Synthetic oligonucleotide
gtccgatcctag

SEQ ID NO: 2757 - DNA, 12 bp, Artificial Sequence
  Description of Artificial Sequence: Synthetic oligonucleotide
atcgacaacacc

SEQ ID NO: 2758 - DNA, 12 bp, Artificial Sequence
  Description of Artificial Sequence: Synthetic oligonucleotide
ggtgaaacctat

SEQ ID NO: 2759 - DNA, 12 bp, Artificial Sequence
  Description of Artificial Sequence: Synthetic oligonucleotide
ctctgcctaatt

SEQ ID NO: 2760 - DNA, 12 bp, Artificial Sequence
  Description of Artificial Sequence: Synthetic oligonucleotide
actaggatcagt

SEQ ID NO: 2761 - DNA, 12 bp, Artificial Sequence
  Description of Artificial Sequence: Synthetic oligonucleotide
ctgtgggattca

SEQ ID NO: 2762 - DNA, 12 bp, Artificial Sequence
  Description of Artificial Sequence: Synthetic oligonucleotide
agcacactacac

SEQ ID NO: 2763 - DNA, 12 bp, Artificial Sequence
  Description of Artificial Sequence: Synthetic oligonucleotide
tggtaagagtct

SEQ ID NO: 2764 - DNA, 12 bp, Artificial Sequence
  Description of Artificial Sequence: Synthetic oligonucleotide
atatgacccagc

SEQ ID NO: 2765 - DNA, 12 bp, Artificial Sequence
  Description of Artificial Sequence: Synthetic oligonucleotide
gctccttagaag

SEQ ID NO: 2766 - DNA, 12 bp, Artificial Sequence
  Description of Artificial Sequence: Synthetic oligonucleotide
ttgtctacctac

SEQ ID NO: 2767 - DNA, 12 bp, Artificial Sequence
  Description of Artificial Sequence: Synthetic oligonucleotide
gaatgttgcgct

SEQ ID NO: 2768 - DNA, 12 bp, Artificial Sequence
  Description of Artificial Sequence: Synthetic oligonucleotide
gcgcttagaata

SEQ ID NO: 2769 - DNA, 12 bp, Artificial Sequence
  Description of Artificial Sequence: Synthetic oligonucleotide
ctctattccacc

SEQ ID NO: 2770 - DNA, 12 bp, Artificial Sequence
  Description of Artificial Sequence: Synthetic oligonucleotide
tcccattcccat

SEQ ID NO: 2771 - DNA, 12 bp, Artificial Sequence
  Description of Artificial Sequence: Synthetic oligonucleotide
gaaggctcctta

SEQ ID NO: 2772 - DNA, 12 bp, Artificial Sequence
  Description of Artificial Sequence: Synthetic oligonucleotide
cgcgcaagtatt

SEQ ID NO: 2773 - DNA, 12 bp, Artificial Sequence
  Description of Artificial Sequence: Synthetic oligonucleotide
aggtgtatcacc

SEQ ID NO: 2774 - DNA, 12 bp, Artificial Sequence
  Description of Artificial Sequence: Synthetic oligonucleotide
attgagtgagtc

SEQ ID NO: 2775 - DNA, 12 bp, Artificial Sequence
  Description of Artificial Sequence: Synthetic oligonucleotide
tggcgtcattcg

SEQ ID NO: 2776 - DNA, 12 bp, Artificial Sequence
  Description of Artificial Sequence: Synthetic oligonucleotide
agattacaaccg

SEQ ID NO: 2777 - DNA, 12 bp, Artificial Sequence
  Description of Artificial Sequence: Synthetic oligonucleotide
atagttagggct

SEQ ID NO: 2778 - DNA, 12 bp, Artificial Sequence
  Description of Artificial Sequence: Synthetic oligonucleotide
attgtcaagcag

SEQ ID NO: 2779 - DNA, 12 bp, Artificial Sequence
  Description of Artificial Sequence: Synthetic oligonucleotide
ttatggtacgga

SEQ ID NO: 2780 - DNA, 12 bp, Artificial Sequence
  Description of Artificial Sequence: Synthetic oligonucleotide
aatcctcggagt

SEQ ID NO: 2781 - DNA, 12 bp, Artificial Sequence
  Description of Artificial Sequence: Synthetic oligonucleotide
tcttctgcccta

SEQ ID NO: 2782 - DNA, 12 bp, Artificial Sequence
  Description of Artificial Sequence: Synthetic oligonucleotide
gttcaacagctg

SEQ ID NO: 2783 - DNA, 12 bp, Artificial Sequence
  Description of Artificial Sequence: Synthetic oligonucleotide
ttcgcagatacg

SEQ ID NO: 2784 - DNA, 12 bp, Artificial Sequence
  Description of Artificial Sequence: Synthetic oligonucleotide
gctagttatgga

SEQ ID NO: 2785 - DNA, 12 bp, Artificial Sequence
  Description of Artificial Sequence: Synthetic oligonucleotide
ctggacgcatta

SEQ ID NO: 2786 - DNA, 12 bp, Artificial Sequence
  Description of Artificial Sequence: Synthetic oligonucleotide
tgaagtcacagt

SEQ ID NO: 2787 - DNA, 12 bp, Artificial Sequence
  Description of Artificial Sequence: Synthetic oligonucleotide
tcagcaaatggt

SEQ ID NO: 2788 - DNA, 12 bp, Artificial Sequence
  Description of Artificial Sequence: Synthetic oligonucleotide
cataggccatca

SEQ ID NO: 2789 - DNA, 12 bp, Artificial Sequence
  Description of Artificial Sequence: Synthetic oligonucleotide
cagattaaccag

SEQ ID NO: 2790 - DNA, 12 bp, Artificial Sequence
  Description of Artificial Sequence: Synthetic oligonucleotide
accgattaggta

SEQ ID NO: 2791 - DNA, 12 bp, Artificial Sequence
  Description of Artificial Sequence: Synthetic oligonucleotide
cttagtgcagaa

SEQ ID NO: 2792 - DNA, 12 bp, Artificial Sequence
  Description of Artificial Sequence: Synthetic oligonucleotide
agggacttcaat

SEQ ID NO: 2793 - DNA, 12 bp, Artificial Sequence
  Description of Artificial Sequence: Synthetic oligonucleotide
ccttggaatcgc

SEQ ID NO: 2794 - DNA, 12 bp, Artificial Sequence
  Description of Artificial Sequence: Synthetic oligonucleotide
ggctgcatactc

SEQ ID NO: 2795 - DNA, 12 bp, Artificial Sequence
  Description of Artificial Sequence: Synthetic oligonucleotide
atgtgctgctcg

SEQ ID NO: 2796 - DNA, 12 bp, Artificial Sequence
  Description of Artificial Sequence: Synthetic oligonucleotide
catcagtacgcc

SEQ ID NO: 2797 - DNA, 12 bp, Artificial Sequence
  Description of Artificial Sequence: Synthetic oligonucleotide
gaagtgtatctg

SEQ ID NO: 2798 - DNA, 12 bp, Artificial Sequence
  Description of Artificial Sequence: Synthetic oligonucleotide
cacttgctctct

SEQ ID NO: 2799 - DNA, 12 bp, Artificial Sequence
  Description of Artificial Sequence: Synthetic oligonucleotide
ttggtaaagtgc

SEQ ID NO: 2800 - DNA, 12 bp, Artificial Sequence
  Description of Artificial Sequence: Synthetic oligonucleotide
tacgtacgaaac

SEQ ID NO: 2801 - DNA, 12 bp, Artificial Sequence
  Description of Artificial Sequence: Synthetic oligonucleotide
tagaacaccatg

SEQ ID NO: 2802 - DNA, 12 bp, Artificial Sequence
  Description of Artificial Sequence: Synthetic oligonucleotide
tcctgtgcgagt

SEQ ID NO: 2803 - DNA, 12 bp, Artificial Sequence
  Description of Artificial Sequence: Synthetic oligonucleotide
gcaacttcggta

SEQ ID NO: 2804 - DNA, 12 bp, Artificial Sequence
  Description of Artificial Sequence: Synthetic oligonucleotide
aagtggctatcc

SEQ ID NO: 2805 - DNA, 12 bp, Artificial Sequence
  Description of Artificial Sequence: Synthetic oligonucleotide
atcacattctcc

SEQ ID NO: 2806 - DNA, 12 bp, Artificial Sequence
  Description of Artificial Sequence: Synthetic oligonucleotide
ccgcatgaccta

SEQ ID NO: 2807 - DNA, 12 bp, Artificial Sequence
  Description of Artificial Sequence: Synthetic oligonucleotide
ccaacgtaacca

SEQ ID NO: 2808 - DNA, 12 bp, Artificial Sequence
  Description of Artificial Sequence: Synthetic oligonucleotide
gccaatccaaca

SEQ ID NO: 2809 - DNA, 12 bp, Artificial Sequence
  Description of Artificial Sequence: Synthetic oligonucleotide
aaccgatgtacc

SEQ ID NO: 2810 - DNA, 12 bp, Artificial Sequence
  Description of Artificial Sequence: Synthetic oligonucleotide
agcctggtacct

SEQ ID NO: 2811 - DNA, 12 bp, Artificial Sequence
  Description of Artificial Sequence: Synthetic oligonucleotide
gagaatggaaag

SEQ ID NO: 2812 - DNA, 12 bp, Artificial Sequence
  Description of Artificial Sequence: Synthetic oligonucleotide
aaggtggacaag

SEQ ID NO: 2813 - DNA, 12 bp, Artificial Sequence
  Description of Artificial Sequence: Synthetic oligonucleotide
ctggaacattag

SEQ ID NO: 2814 - DNA, 12 bp, Artificial Sequence
  Description of Artificial Sequence: Synthetic oligonucleotide
tcgattggccgt

SEQ ID NO: 2815 - DNA, 12 bp, Artificial Sequence
  Description of Artificial Sequence: Synthetic oligonucleotide
gctaaagtcgta

SEQ ID NO: 2816 - DNA, 12 bp, Artificial Sequence
  Description of Artificial Sequence: Synthetic oligonucleotide
aaccctaactgg

SEQ ID NO: 2817 - DNA, 12 bp, Artificial Sequence
  Description of Artificial Sequence: Synthetic oligonucleotide
caattgcgtgca

SEQ ID NO: 2818 - DNA, 12 bp, Artificial Sequence
  Description of Artificial Sequence: Synthetic oligonucleotide
ttagcccagcgt

SEQ ID NO: 2819 - DNA, 12 bp, Artificial Sequence
  Description of Artificial Sequence: Synthetic oligonucleotide
gcattactggac

SEQ ID NO: 2820 - DNA, 12 bp, Artificial Sequence
  Description of Artificial Sequence: Synthetic oligonucleotide
tctcagcgcgta

SEQ ID NO: 2821 - DNA, 12 bp, Artificial Sequence
  Description of Artificial Sequence: Synthetic oligonucleotide
tccataccggaa

SEQ ID NO: 2822 - DNA, 12 bp, Artificial Sequence
  Description of Artificial Sequence: Synthetic oligonucleotide
accagctcagat

SEQ ID NO: 2823 - DNA, 12 bp, Artificial Sequence
  Description of Artificial Sequence: Synthetic oligonucleotide
aatggttcagca

SEQ ID NO: 2824 - DNA, 12 bp, Artificial Sequence
  Description of Artificial Sequence: Synthetic oligonucleotide
ttgggccacata

SEQ ID NO: 2825 - DNA, 12 bp, Artificial Sequence
  Description of Artificial Sequence: Synthetic oligonucleotide
gaccctagacct

SEQ ID NO: 2826 - DNA, 12 bp, Artificial Sequence
  Description of Artificial Sequence: Synthetic oligonucleotide
gttcagactagc

SEQ ID NO: 2827 - DNA, 12 bp, Artificial Sequence
  Description of Artificial Sequence: Synthetic oligonucleotide
acggtaccctac

SEQ ID NO: 2828 - DNA, 12 bp, Artificial Sequence
  Description of Artificial Sequence: Synthetic oligonucleotide
cagcaagaggac

SEQ ID NO: 2829 - DNA, 12 bp, Artificial Sequence
  Description of Artificial Sequence: Synthetic oligonucleotide
cacacaaagtca

SEQ ID NO: 2830 - DNA, 12 bp, Artificial Sequence
  Description of Artificial Sequence: Synthetic oligonucleotide
tattcagcggac

SEQ ID NO: 2831 - DNA, 12 bp, Artificial Sequence
  Description of Artificial Sequence: Synthetic oligonucleotide
gacaccacaata

SEQ ID NO: 2832 - DNA, 12 bp, Artificial Sequence
  Description of Artificial Sequence: Synthetic oligonucleotide
tcatagggtagt

SEQ ID NO: 2833 - DNA, 12 bp, Artificial Sequence
  Description of Artificial Sequence: Synthetic oligonucleotide
ctagtacaagcc

SEQ ID NO: 2834 - DNA, 12 bp, Artificial Sequence
  Description of Artificial Sequence: Synthetic oligonucleotide
gccaaggatagg

SEQ ID NO: 2835 - DNA, 12 bp, Artificial Sequence
  Description of Artificial Sequence: Synthetic oligonucleotide
gttccggattag

SEQ ID NO: 2836 - DNA, 12 bp, Artificial Sequence
  Description of Artificial Sequence: Synthetic oligonucleotide
cgatttaggcca

SEQ ID NO: 2837 - DNA, 12 bp, Artificial Sequence
  Description of Artificial Sequence: Synthetic oligonucleotide
atggagttgttg

SEQ ID NO: 2838 - DNA, 12 bp, Artificial Sequence
  Description of Artificial Sequence: Synthetic oligonucleotide
agagcggaacaa

SEQ ID NO: 2839 - DNA, 12 bp, Artificial Sequence
  Description of Artificial Sequence: Synthetic oligonucleotide
cgccacgtgtat

SEQ ID NO: 2840 - DNA, 12 bp, Artificial Sequence
  Description of Artificial Sequence: Synthetic oligonucleotide
gcgtgtaattag

SEQ ID NO: 2841 - DNA, 12 bp, Artificial Sequence
  Description of Artificial Sequence: Synthetic oligonucleotide
aggatattcgtg

SEQ ID NO: 2842 - DNA, 12 bp, Artificial Sequence
  Description of Artificial Sequence: Synthetic oligonucleotide
cgtatctcagga

SEQ ID NO: 2843 - DNA, 12 bp, Artificial Sequence
  Description of Artificial Sequence: Synthetic oligonucleotide
gcagttgcctca

SEQ ID NO: 2844 - DNA, 12 bp, Artificial Sequence
  Description of Artificial Sequence: Synthetic oligonucleotide
gcaaccgattgt

SEQ ID NO: 2845 - DNA, 12 bp, Artificial Sequence
  Description of Artificial Sequence: Synthetic oligonucleotide
ctgtagcttggc

SEQ ID NO: 2846 - DNA, 12 bp, Artificial Sequence
  Description of Artificial Sequence: Synthetic oligonucleotide
caatacgaccgt

SEQ ID NO: 2847 - DNA, 12 bp, Artificial Sequence
  Description of Artificial Sequence: Synthetic oligonucleotide
tagttcggtgac

SEQ ID NO: 2848 - DNA, 12 bp, Artificial Sequence
  Description of Artificial Sequence: Synthetic oligonucleotide
cgcgccttaaac

SEQ ID NO: 2849 - DNA, 12 bp, Artificial Sequence
  Description of Artificial Sequence: Synthetic oligonucleotide
catgtgcttagg

SEQ ID NO: 2850 - DNA, 12 bp, Artificial Sequence
  Description of Artificial Sequence: Synthetic oligonucleotide
atgcctcgtaag

SEQ ID NO: 2851 - DNA, 12 bp, Artificial Sequence
  Description of Artificial Sequence: Synthetic oligonucleotide
gccatgtgtgta

SEQ ID NO: 2852 - DNA, 12 bp, Artificial Sequence
  Description of Artificial Sequence: Synthetic oligonucleotide
ccatggctgtgt

SEQ ID NO: 2853 - DNA, 12 bp, Artificial Sequence
  Description of Artificial Sequence: Synthetic oligonucleotide
tccgcgcaagtt

SEQ ID NO: 2854 - DNA, 12 bp, Artificial Sequence
  Description of Artificial Sequence: Synthetic oligonucleotide
gttcctccatta

SEQ ID NO: 2855 - DNA, 12 bp, Artificial Sequence
  Description of Artificial Sequence: Synthetic oligonucleotide
acctatggtgaa

SEQ ID NO: 2856 - DNA, 12 bp, Artificial Sequence
  Description of Artificial Sequence: Synthetic oligonucleotide
gactcctagacc

SEQ ID NO: 2857 - DNA, 12 bp, Artificial Sequence
  Description of Artificial Sequence: Synthetic oligonucleotide
ctagtcgctggt

SEQ ID NO: 2858 - DNA, 12 bp, Artificial Sequence
  Description of Artificial Sequence: Synthetic oligonucleotide
taaccaccaacg

SEQ ID NO: 2859 - DNA, 12 bp, Artificial Sequence
  Description of Artificial Sequence: Synthetic oligonucleotide
acctgtcctttc

SEQ ID NO: 2860 - DNA, 12 bp, Artificial Sequence
  Description of Artificial Sequence: Synthetic oligonucleotide
ctgttacagcga

SEQ ID NO: 2861 - DNA, 12 bp, Artificial Sequence
  Description of Artificial Sequence: Synthetic oligonucleotide
aaggcaagaaga

SEQ ID NO: 2862 - DNA, 12 bp, Artificial Sequence
  Description of Artificial Sequence: Synthetic oligonucleotide
tccaagcgtcac

SEQ ID NO: 2863 - DNA, 12 bp, Artificial Sequence
  Description of Artificial Sequence: Synthetic oligonucleotide
tgcgtcagctac

SEQ ID NO: 2864 - DNA, 12 bp, Artificial Sequence
  Description of Artificial Sequence: Synthetic oligonucleotide
gttcacgcccaa

SEQ ID NO: 2865 - DNA, 12 bp, Artificial Sequence
  Description of Artificial Sequence: Synthetic oligonucleotide
cagtcaggcctt

SEQ ID NO: 2866 - DNA, 12 bp, Artificial Sequence
  Description of Artificial Sequence: Synthetic oligonucleotide
acgaggagtcga

SEQ ID NO: 2867 - DNA, 12 bp, Artificial Sequence
  Description of Artificial Sequence: Synthetic oligonucleotide
gcttcatttctg

SEQ ID NO: 2868 - DNA, 12 bp, Artificial Sequence
  Description of Artificial Sequence: Synthetic oligonucleotide
cgaaatgcatgt

SEQ ID NO: 2869 - DNA, 12 bp, Artificial Sequence
  Description of Artificial Sequence: Synthetic oligonucleotide
cgatcgaacact

SEQ ID NO: 2870 - DNA, 12 bp, Artificial Sequence
  Description of Artificial Sequence: Synthetic oligonucleotide
actgagctgcat

SEQ ID NO: 2871 - DNA, 12 bp, Artificial Sequence
  Description of Artificial Sequence: Synthetic oligonucleotide
gcggtactacta

SEQ ID NO: 2872 - DNA, 12 bp, Artificial Sequence
  Description of Artificial Sequence: Synthetic oligonucleotide
aacttggccgta

SEQ ID NO: 2873 - DNA, 12 bp, Artificial Sequence
  Description of Artificial Sequence: Synthetic oligonucleotide
atgatcggtaca

SEQ ID NO: 2874 - DNA, 12 bp, Artificial Sequence
  Description of Artificial Sequence: Synthetic oligonucleotide
catgccaacatg

SEQ ID NO: 2875 - DNA, 12 bp, Artificial Sequence
  Description of Artificial Sequence: Synthetic oligonucleotide
acgaagtctacc

SEQ ID NO: 2876 - DNA, 12 bp, Artificial Sequence
  Description of Artificial Sequence: Synthetic oligonucleotide
tcagctgactag

SEQ ID NO: 2877 - DNA, 12 bp, Artificial Sequence
  Description of Artificial Sequence: Synthetic oligonucleotide
catacgatacag

SEQ ID NO: 2878 - DNA, 12 bp, Artificial Sequence
  Description of Artificial Sequence: Synthetic oligonucleotide
ttacccgcacag

SEQ ID NO: 2879 - DNA, 12 bp, Artificial Sequence
  Description of Artificial Sequence: Synthetic oligonucleotide
gagtacagtcta

SEQ ID NO: 2880 - DNA, 12 bp, Artificial Sequence
  Description of Artificial Sequence: Synthetic oligonucleotide
accgtctttctc

SEQ ID NO: 2881 - DNA, 12 bp, Artificial Sequence
  Description of Artificial Sequence: Synthetic oligonucleotide
acctgatccgca

SEQ ID NO: 2882 - DNA, 12 bp, Artificial Sequence
  Description of Artificial Sequence: Synthetic oligonucleotide
ggttgagaagag

SEQ ID NO: 2883 - DNA, 12 bp, Artificial Sequence
  Description of Artificial Sequence: Synthetic oligonucleotide
cctgttagcgaa

SEQ ID NO: 2884 - DNA, 12 bp, Artificial Sequence
  Description of Artificial Sequence: Synthetic oligonucleotide
cctacatgagac

SEQ ID NO: 2885 - DNA, 12 bp, Artificial Sequence
  Description of Artificial Sequence: Synthetic oligonucleotide
agtctgtctgcg

SEQ ID NO: 2886 - DNA, 12 bp, Artificial Sequence
  Description of Artificial Sequence: Synthetic oligonucleotide
caagctagctgt

SEQ ID NO: 2887 - DNA, 12 bp, Artificial Sequence
  Description of Artificial Sequence: Synthetic oligonucleotide
ctgggagttgtt

SEQ ID NO: 2888 - DNA, 12 bp, Artificial Sequence
  Description of Artificial Sequence: Synthetic oligonucleotide
gctccgaccata

SEQ ID NO: 2889 - DNA, 12 bp, Artificial Sequence
  Description of Artificial Sequence: Synthetic oligonucleotide
tccgtggtatag

SEQ ID NO: 2890 - DNA, 12 bp, Artificial Sequence
  Description of Artificial Sequence: Synthetic oligonucleotide
ccgcactcaagt

SEQ ID NO: 2891 - DNA, 12 bp, Artificial Sequence
  Description of Artificial Sequence: Synthetic oligonucleotide
gtggataaactc

SEQ ID NO: 2892 - DNA, 12 bp, Artificial Sequence
  Description of Artificial Sequence: Synthetic oligonucleotide
atcatctcggcg

SEQ ID NO: 2893 - DNA, 12 bp, Artificial Sequence
  Description of Artificial Sequence: Synthetic oligonucleotide
acaaatcgttgg

SEQ ID NO: 2894 - DNA, 12 bp, Artificial Sequence
  Description of Artificial Sequence: Synthetic oligonucleotide
tctacggcacgt

SEQ ID NO: 2895 - DNA, 12 bp, Artificial Sequence
  Description of Artificial Sequence: Synthetic oligonucleotide
tgtggaaactcc

SEQ ID NO: 2896 - DNA, 12 bp, Artificial Sequence
  Description of Artificial Sequence: Synthetic oligonucleotide
ggtacaatgatc

SEQ ID NO: 2897 - DNA, 12 bp, Artificial Sequence
  Description of Artificial Sequence: Synthetic oligonucleotide
attacccacagg

SEQ ID NO: 2898 - DNA, 12 bp, Artificial Sequence
  Description of Artificial Sequence: Synthetic oligonucleotide
gaaggaaagtag

SEQ ID NO: 2899 - DNA, 12 bp, Artificial Sequence
  Description of Artificial Sequence: Synthetic oligonucleotide
atgctgcaacac

SEQ ID NO: 2900 - DNA, 12 bp, Artificial Sequence
  Description of Artificial Sequence: Synthetic oligonucleotide
ttaggcaggttc

SEQ ID NO: 2901 - DNA, 12 bp, Artificial Sequence
  Description of Artificial Sequence: Synthetic oligonucleotide
actgtcgcagta

SEQ ID NO: 2902 - DNA, 12 bp, Artificial Sequence
  Description of Artificial Sequence: Synthetic oligonucleotide
cacatcagcgct

SEQ ID NO: 2903 - DNA, 12 bp, Artificial Sequence
  Description of Artificial Sequence: Synthetic oligonucleotide
acaaacatggtc

SEQ ID NO: 2904 - DNA, 12 bp, Artificial Sequence
  Description of Artificial Sequence: Synthetic oligonucleotide
ttctcatggagg

SEQ ID NO: 2905 - DNA, 12 bp, Artificial Sequence
  Description of Artificial Sequence: Synthetic oligonucleotide
taagactactgg

SEQ ID NO: 2906 - DNA, 12 bp, Artificial Sequence
  Description of Artificial Sequence: Synthetic oligonucleotide
catcctgagcaa

SEQ ID NO: 2907 - DNA, 12 bp, Artificial Sequence
  Description of Artificial Sequence: Synthetic oligonucleotide
tgaccatagtga

SEQ ID NO: 2908 - DNA, 12 bp, Artificial Sequence
  Description of Artificial Sequence: Synthetic oligonucleotide
ggactatcgttg

SEQ ID NO: 2909 - DNA, 12 bp, Artificial Sequence
  Description of Artificial Sequence: Synthetic oligonucleotide
catagtgattgg

SEQ ID NO: 2910 - DNA, 12 bp, Artificial Sequence
  Description of Artificial Sequence: Synthetic oligonucleotide
cgcgaagtttca

SEQ ID NO: 2911 - DNA, 12 bp, Artificial Sequence
  Description of Artificial Sequence: Synthetic oligonucleotide
caacatcgtagc

SEQ ID NO: 2912 - DNA, 12 bp, Artificial Sequence
  Description of Artificial Sequence: Synthetic oligonucleotide
gataagcgcctt

SEQ ID NO: 2913 - DNA, 12 bp, Artificial Sequence
  Description of Artificial Sequence: Synthetic oligonucleotide
gctatatccagg

SEQ ID NO: 2914 - DNA, 12 bp, Artificial Sequence
  Description of Artificial Sequence: Synthetic oligonucleotide
gctatcaagaca

SEQ ID NO: 2915 - DNA, 12 bp, Artificial Sequence
  Description of Artificial Sequence: Synthetic oligonucleotide
cgatacactgcc

SEQ ID NO: 2916 - DNA, 12 bp, Artificial Sequence
  Description of Artificial Sequence: Synthetic oligonucleotide
ggcaatcatctg

SEQ ID NO: 2917 - DNA, 12 bp, Artificial Sequence
  Description of Artificial Sequence: Synthetic oligonucleotide
tagtctaagggt

SEQ ID NO: 2918 - DNA, 12 bp, Artificial Sequence
  Description of Artificial Sequence: Synthetic oligonucleotide
tattcccacgtt

SEQ ID NO: 2919 - DNA, 12 bp, Artificial Sequence
  Description of Artificial Sequence: Synthetic oligonucleotide
ccgtgacaactc

SEQ ID NO: 2920 - DNA, 12 bp, Artificial Sequence
  Description of Artificial Sequence: Synthetic oligonucleotide
ttgaaatcccgg

SEQ ID NO: 2921 - DNA, 12 bp, Artificial Sequence
  Description of Artificial Sequence: Synthetic oligonucleotide
tatcgcgcgata

SEQ ID NO: 2922 - DNA, 12 bp, Artificial Sequence
  Description of Artificial Sequence: Synthetic oligonucleotide
aattaggcgtgt

SEQ ID NO: 2923 - DNA, 12 bp, Artificial Sequence
  Description of Artificial Sequence: Synthetic oligonucleotide
ccattagttcct

SEQ ID NO: 2924 - DNA, 12 bp, Artificial Sequence
  Description of Artificial Sequence: Synthetic oligonucleotide
cgttccttgtta

SEQ ID NO: 2925 - DNA, 12 bp, Artificial Sequence
  Description of Artificial Sequence: Synthetic oligonucleotide
gttagggagcga

SEQ ID NO: 2926 - DNA, 12 bp, Artificial Sequence
  Description of Artificial Sequence: Synthetic oligonucleotide
tacggtctggat

SEQ ID NO: 2927 - DNA, 12 bp, Artificial Sequence
  Description of Artificial Sequence: Synthetic oligonucleotide
tgctcttgctct

SEQ ID NO: 2928 - DNA, 12 bp, Artificial Sequence
  Description of Artificial Sequence: Synthetic oligonucleotide
taaccttcgctt

SEQ ID NO: 2929 - DNA, 12 bp, Artificial Sequence
  Description of Artificial Sequence: Synthetic oligonucleotide
ggaattatcggt

SEQ ID NO: 2930 - DNA, 12 bp, Artificial Sequence
  Description of Artificial Sequence: Synthetic oligonucleotide
ttactgtggccg

SEQ ID NO: 2931 - DNA, 12 bp, Artificial Sequence
  Description of Artificial Sequence: Synthetic oligonucleotide
tcgttcaggacc

SEQ ID NO: 2932 - DNA, 12 bp, Artificial Sequence
  Description of Artificial Sequence: Synthetic oligonucleotide
tccactagagca

SEQ ID NO: 2933 - DNA, 12 bp, Artificial Sequence
  Description of Artificial Sequence: Synthetic oligonucleotide
gtaatctgccga

SEQ ID NO: 2934 - DNA, 12 bp, Artificial Sequence
  Description of Artificial Sequence: Synthetic oligonucleotide
catcaagcatag

SEQ ID NO: 2935 - DNA, 12 bp, Artificial Sequence
  Description of Artificial Sequence: Synthetic oligonucleotide
atataaggccca

SEQ ID NO: 2936 - DNA, 12 bp, Artificial Sequence
  Description of Artificial Sequence: Synthetic oligonucleotide
tgatccgggtat

SEQ ID NO: 2937 - DNA, 12 bp, Artificial Sequence
  Description of Artificial Sequence: Synthetic oligonucleotide
cattgcaaagca

SEQ ID NO: 2938 - DNA, 12 bp, Artificial Sequence
  Description of Artificial Sequence: Synthetic oligonucleotide
ggtggcatggaa

SEQ ID NO: 2939 - DNA, 132 bp, Artificial Sequence
  Description of Artificial Sequence: Synthetic polynucleotide
cctacgggaggcatcaggcagatctcgtcccttgtctccacgagactgattatgattacagttaacagtatcttaatgattacagttaacagtatcttaagtcagtcagccggattagataccctagtagtc

SEQ ID NO: 2940 - DNA, 132 bp, Artificial Sequence
  Description of Artificial Sequence: Synthetic polynucleotide
cctacgggaggcatcaggcagatctcgtcccttgtctccacgagactgattctgactgcagttagcagtacctgaatgctgacagtcagcagtacctgaagtcagtcagccggattagataccctagtagtc

SEQ ID NO: 2941 - DNA, 132 bp, Artificial Sequence
  Description of Artificial Sequence: Synthetic polynucleotide
cctacgggaggcatcaggcagatctcgtcccttgtctccacgagactgattcgacggctcaggcctcagcgtggccgacggctgaggcctcagcgtggcagtcagtcagccggattagataccctagtagtc

SEQ ID NO: 2942 - DNA, 132 bp, Artificial Sequence
  Description of Artificial Sequence: Synthetic polynucleotide
cctacgggaggcatcaggcagatctcggctgtacggattatcaccaggtgtatgattacagttaacagtatcttaatgattacagttaacagtatcttaagtcagtcagccggattagataccctagtagtc

SEQ ID NO: 2943 - DNA, 132 bp, Artificial Sequence
  Description of Artificial Sequence: Synthetic polynucleotide
cctacgggaggcatcaggcagatctcggctgtacggattatcaccaggtgtctgactgcagttagcagtacctgaatgctgacagtcagcagtacctgaagtcagtcagccggattagataccctagtagtc

SEQ ID NO: 2944 - DNA, 132 bp, Artificial Sequence
  Description of Artificial Sequence: Synthetic polynucleotide
cctacgggaggcatcaggcagatctcggctgtacggattatcaccaggtgtcgacggctcaggcctcagcgtggccgacggctgaggcctcagcgtggcagtcagtcagccggattagataccctagtagtc

SEQ ID NO: 2945 - DNA, 132 bp, Artificial Sequence; identical to SEQ ID NO: 2939
  Description of Artificial Sequence: Synthetic polynucleotide

SEQ ID NO: 2946 - DNA, 132 bp, Artificial Sequence; identical to SEQ ID NO: 2940
  Description of Artificial Sequence: Synthetic polynucleotide

SEQ ID NO: 2947 - DNA, 132 bp, Artificial Sequence; identical to SEQ ID NO: 2941
  Description of Artificial Sequence: Synthetic polynucleotide

SEQ ID NO: 2948 - DNA, 132 bp, Artificial Sequence; identical to SEQ ID NO: 2942
  Description of Artificial Sequence: Synthetic polynucleotide

SEQ ID NO: 2949 - DNA, 132 bp, Artificial Sequence; identical to SEQ ID NO: 2943
  Description of Artificial Sequence: Synthetic polynucleotide

SEQ ID NO: 2950 - DNA, 132 bp, Artificial Sequence; identical to SEQ ID NO: 2944
  Description of Artificial Sequence: Synthetic polynucleotide

SEQ ID NO: 2951 - DNA, 110 bp, Artificial Sequence
  Description of Artificial Sequence: Synthetic polynucleotide
gcagatctcgtacgcgaatcccttgtctccacgagactgattatgattacagttaacagtatcttaatgattacagttaacagtatcttagtcatgacagtcagtcagcc

SEQ ID NO: 2952 - DNA, 110 bp, Artificial Sequence
  Description of Artificial Sequence: Synthetic polynucleotide
gcagatctcgtacgcgaatcccttgtctccacgagactgattctgactgcagttagcagtacctgaatgctgacagtcagcagtacctgagtcatgacagtcagtcagcc

SEQ ID NO: 2953 - DNA, 110 bp, Artificial Sequence
  Description of Artificial Sequence: Synthetic polynucleotide
gcagatctcgtacgcgaatcccttgtctccacgagactgattcgacggctcaggcctcagcgtggccgacggctgaggcctcagcgtggcgtcatgacagtcagtcagcc

SEQ ID NO: 2954 - DNA, 110 bp, Artificial Sequence
  Description of Artificial Sequence: Synthetic polynucleotide
gcagatctcgtacgcgaagctgtacggattatcaccaggtgtatgattacagttaacagtatcttaatgattacagttaacagtatcttagtcatgacagtcagtcagcc

SEQ ID NO: 2955 - DNA, 110 bp, Artificial Sequence
  Description of Artificial Sequence: Synthetic polynucleotide
gcagatctcgtacgcgaagctgtacggattatcaccaggtgtctgactgcagttagcagtacctgaatgctgacagtcagcagtacctgagtcatgacagtcagtcagcc

SEQ ID NO: 2956 - DNA, 110 bp, Artificial Sequence
  Description of Artificial Sequence: Synthetic polynucleotide
gcagatctcgtacgcgaagctgtacggattatcaccaggtgtcgacggctcaggcctcagcgtggccgacggctgaggcctcagcgtggcgtcatgacagtcagtcagcc

SEQ ID NO: 2957 - DNA, 110 bp, Artificial Sequence; identical to SEQ ID NO: 2951
  Description of Artificial Sequence: Synthetic polynucleotide

SEQ ID NO: 2958 - DNA, 110 bp, Artificial Sequence; identical to SEQ ID NO: 2952
  Description of Artificial Sequence: Synthetic polynucleotide

SEQ ID NO: 2959 - DNA, 110 bp, Artificial Sequence; identical to SEQ ID NO: 2953
  Description of Artificial Sequence: Synthetic polynucleotide

SEQ ID NO: 2960 - DNA, 110 bp, Artificial Sequence; identical to SEQ ID NO: 2954
  Description of Artificial Sequence: Synthetic polynucleotide

SEQ ID NO: 2961 - DNA, 110 bp, Artificial Sequence; identical to SEQ ID NO: 2955
  Description of Artificial Sequence: Synthetic polynucleotide

SEQ ID NO: 2962 - DNA, 110 bp, Artificial Sequence; identical to SEQ ID NO: 2956
  Description of Artificial Sequence: Synthetic polynucleotide

What is claimed is:

1. A method for monitoring sample cross-contamination and/or sample swapping, and for quantitation of nucleic acids during sequencing, the method comprising,
   a) spiking a first sample comprising prokaryotic or eukaryotic cells with a first control composition comprising a first nucleic acid construct wherein the first nucleic acid construct comprises at least one barcode sequence fragment, at least one universal sequence fragment, and at least one GC content fragment, and wherein the first nucleic acid construct is a deoxyribonucleic acid construct;
   b) extracting total DNA from the first sample wherein total DNA comprises the DNA from the first sample and the DNA from the first nucleic acid construct;
   c) purifying total DNA;
   d) preparing a library from total DNA;
   e) sequencing total DNA;
   f) detecting and quantifying the first nucleic acid construct in total DNA;
   g) spiking a second sample comprising the prokaryotic or eukaryotic cells with a second control composition, wherein the second control composition comprises a different nucleic acid construct than the first control composition with a different barcode sequence fragment linked to at least one universal sequence fragment and then performing steps b) to f) for the second sample wherein the second nucleic acid construct is detected and quantified in step f), and wherein detection of the different barcode sequence fragments in the first sample and the second sample is used to determine if cross-contamination between the first sample and the second sample or sample swapping between the first sample and the second sample occurred during sample preparation or processing and wherein the quantification of the GC content fragments in the first sample and the second sample is used to control for enzyme GC content bias; and
   h) comparing the extraction efficiency of the first and second nucleic acid constructs with the extraction efficiency of the DNA in the first and second samples to control for extraction efficiency wherein the first nucleic acid construct and the second nucleic acid construct are separately encapsulated in a simulated cell membrane that mimics the cell membrane of the prokaryotic or eukaryotic cells in the first sample and the second sample to control for extraction efficiency.

2. The method of claim 1 wherein sample cross-contamination and/or sample swapping can be monitored over all steps of a DNA sequencing protocol including collection of the first and second sample, extraction of total DNA, purification of the extracted total DNA, library preparation, and sequencing.

3. The method of claim 1 wherein the first and second control composition comprises nucleic acid constructs with GC content fragments with at least two, at least three, or at least four different percent GC contents.

4. The method of claim 3 wherein the GC content fragment is used to control for polymerase, transposase, ligase, or repair enzyme GC content bias.

5. The method of claim 1 wherein the GC content fragment is used to control for polymerase, transposase, ligase, or repair enzyme GC content bias.

6. The method of claim 1 wherein the first and second nucleic acid construct is present at at least two, at least three, at least four, or at least five different concentrations for use in generating a standard curve for the quantification of nucleic acids during sequencing.

7. The method of claim 1 wherein detecting and quantifying the first and second nucleic acid constructs in total DNA comprises:
   a) identifying each universal sequence fragment in sequencing reads generated by sequencing the total DNA;
   b) identifying the barcode sequence fragment in each sequencing read identified as including a universal sequence fragment; and
   c) counting the number of occurrences of each of the first and second barcode sequence fragments identified in the sequencing reads generated by sequencing the total DNA.

8. The method of claim 7, wherein the identifying steps are performed using a textmatching algorithm.

9. The method of claim 8 wherein identifying each universal sequence fragment comprises referencing a database of universal sequence fragments that may be included in the nucleic acid construct of the control composition.

10. The method of claim 8 wherein each universal sequence fragment comprises referencing a database of universal sequence fragments that may be included in the nucleic acid construct of the control composition.

11. The method of claim 8 further comprising comparing the number of occurrences of each of the first and second barcode sequence fragments identified in the sequencing reads generated by sequencing the total DNA to a known concentration of the nucleic acid constructs comprising the first and second barcode sequence fragments in the control compositions that were used to spike the first and second samples.

12. The method of claim 11 wherein the comparing step comprises referencing a database of barcode sequence fragments that may be included in the nucleic acid construct of the control composition.

13. The method of claim 8 further comprising determining that cross-contamination or sample swapping has occurred in response to identifying the second barcode sequence fragment in the sequencing reads generated by sequencing the total DNA of the first sample or identifying the first barcode sequence fragment in the sequencing reads generated by sequencing the total DNA of the second sample.

14. The method of claim 8 further comprising identifying the GC content fragment in each sequencing read identified as including a universal sequence fragment and counting the number of occurrences of each unique GC content fragment identified in the sequencing reads generated by sequencing the total DNA.

15. The method of claim 14, further comprising comparing the number of occurrences of each unique GC content fragment identified in the sequencing reads generated by sequencing the total DNA to a known concentration of the nucleic acid construct comprising that GC content fragment in the control composition that was used to spike the sample.

16. The method of claim 1 wherein the universal sequence fragment adds length to the nucleic acid construct and is a marker for bioinformatic analysis to identify the beginning and end of the barcode sequence fragment after sequencing.

* * * * *